(12) United States Patent
Liu et al.

(10) Patent No.: US 10,947,530 B2
(45) Date of Patent: *Mar. 16, 2021

(54) ADENOSINE NUCLEOBASE EDITORS AND USES THEREOF

(71) Applicant: President and Fellows of Harvard College, Cambridge, MA (US)

(72) Inventors: David R. Liu, Lexington, MA (US); Nicole Gaudelli, Belmont, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/143,370

(22) Filed: Sep. 26, 2018

(65) Prior Publication Data

US 2019/0093099 A1 Mar. 28, 2019

Related U.S. Application Data

(63) Continuation of application No. 15/791,085, which is a continuation of application No. PCT/US2017/045381, filed on Aug. 3, 2017, now Pat. No. 10,113,163.

(60) Provisional application No. 62/473,714, filed on Mar. 20, 2017, provisional application No. 62/454,035, filed on Feb. 2, 2017, provisional application No. 62/370,684, filed on Aug. 3, 2016.

(51) Int. Cl.
*C12N 15/10* (2006.01)
*C12N 9/78* (2006.01)
*C12N 9/22* (2006.01)

(52) U.S. Cl.
CPC .......... *C12N 15/1024* (2013.01); *C12N 9/22* (2013.01); *C12N 9/78* (2013.01); *C12Y 305/04004* (2013.01)

(58) Field of Classification Search
None
See application file for complete search history.

(56) References Cited

U.S. PATENT DOCUMENTS

| | | |
|---|---|---|
| 4,182,449 A | 1/1980 | Kozlow |
| 4,235,871 A | 11/1980 | Papahadjopoulos et al. |
| 4,501,728 A | 2/1985 | Geho et al. |
| 4,737,323 A | 4/1988 | Martin et al. |
| 4,837,028 A | 6/1989 | Allen |
| 4,880,635 A | 11/1989 | Janoff et al. |
| 4,906,477 A | 3/1990 | Kurono et al. |
| 4,911,928 A | 3/1990 | Wallach |
| 4,917,951 A | 4/1990 | Wallach |
| 4,920,016 A | 4/1990 | Allen et al. |
| 4,921,757 A | 5/1990 | Wheatley et al. |
| 5,139,941 A | 8/1992 | Muzyczka et al. |
| 5,449,639 A | 9/1995 | Wei et al. |
| 5,580,737 A | 12/1996 | Polisky et al. |
| 5,767,099 A | 6/1998 | Harris et al. |
| 5,780,053 A | 7/1998 | Ashley et al. |
| 5,830,430 A | 11/1998 | Unger et al. |
| 5,835,699 A | 11/1998 | Kimura |
| 5,851,548 A | 12/1998 | Dattagupta et al. |
| 5,855,910 A | 1/1999 | Ashley et al. |
| 5,962,313 A | 10/1999 | Podsakoff et al. |
| 5,981,182 A | 11/1999 | Jacobs, Jr. et al. |
| 6,057,153 A | 5/2000 | George et al. |
| 6,453,242 B1 | 9/2002 | Eisenberg et al. |
| 6,503,717 B2 | 1/2003 | Case et al. |
| 6,534,261 B1 | 3/2003 | Cox, III et al. |
| 6,599,692 B1 | 7/2003 | Case et al. |
| 6,607,882 B1 | 8/2003 | Cox, III et al. |
| 6,689,558 B2 | 2/2004 | Case |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,013,219 B2 | 3/2006 | Case et al. |
| 7,163,824 B2 | 1/2007 | Cox, III et al. |
| 7,479,573 B2 | 1/2009 | Chu et al. |
| 7,794,931 B2 | 9/2010 | Breaker et al. |
| 7,919,277 B2 | 4/2011 | Russell et al. |
| 7,993,672 B2 | 8/2011 | Huang et al. |
| 8,361,725 B2 | 1/2013 | Russell et al. |
| 8,394,604 B2 | 3/2013 | Liu et al. |
| 8,492,082 B2 | 7/2013 | De Franciscis et al. |
| 8,546,553 B2 | 10/2013 | Terns et al. |
| 8,569,256 B2 | 10/2013 | Heyes et al. |
| 8,680,069 B2 | 3/2014 | de Fougerolles et al. |

(Continued)

FOREIGN PATENT DOCUMENTS

| | | |
|---|---|---|
| AU | 2012244264 A1 | 11/2012 |
| AU | 2015252023 A1 | 11/2015 |

(Continued)

OTHER PUBLICATIONS

U.S. Appl. No. 61/838,178, Joung et al., filed Jun. 21, 2013.

(Continued)

*Primary Examiner* — Paul J Holland

(74) *Attorney, Agent, or Firm* — Wolf, Greenfield & Sacks, P.C.

(57) ABSTRACT

The disclosure provides adenosine deaminases that are capable of deaminating adenosine in DNA. The disclosure also provides fusion proteins comprising a Cas9 (e.g., a Cas9 nickase) domain and adenosine deaminases that deaminate adenosine in DNA. In some embodiments, the fusion proteins further comprise a nuclear localization sequence (NLS), and/or an inhibitor of base repair, such as, a nuclease dead inosine specific nuclease (dISN).

23 Claims, 248 Drawing Sheets

Specification includes a Sequence Listing.

(56) References Cited

U.S. PATENT DOCUMENTS

| | | |
|---|---|---|
| 8,691,750 B2 | 4/2014 | Constien et al. |
| 8,697,359 B1 | 4/2014 | Zhang |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,795,965 B2 | 8/2014 | Zhang |
| 8,846,578 B2 | 9/2014 | McCray et al. |
| 8,993,233 B2 | 3/2015 | Zhang et al. |
| 8,999,641 B2 | 4/2015 | Zhang et al. |
| 9,068,179 B1 | 6/2015 | Liu et al. |
| 9,163,284 B2 | 10/2015 | Liu et al. |
| 9,228,207 B2 | 1/2016 | Liu et al. |
| 9,234,213 B2 | 1/2016 | Wu |
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,512,446 B1 | 12/2016 | Joung et al. |
| 9,526,724 B2 | 12/2016 | Oshlack et al. |
| 9,526,784 B2 | 12/2016 | Liu et al. |
| 9,737,604 B2 | 8/2017 | Liu et al. |
| 9,816,093 B1 | 11/2017 | Donohoue et al. |
| 9,840,690 B2 | 12/2017 | Karli et al. |
| 9,840,699 B2 | 12/2017 | Liu et al. |
| 9,873,907 B2 | 1/2018 | Zeiner et al. |
| 9,879,270 B2 | 1/2018 | Hittinger et al. |
| 9,938,288 B1 | 4/2018 | Kishi et al. |
| 9,944,933 B2 | 4/2018 | Storici et al. |
| 9,982,279 B1 | 5/2018 | Gill et al. |
| 9,999,671 B2 | 6/2018 | Liu et al. |
| 10,059,940 B2 | 8/2018 | Zhong |
| 10,077,453 B2 | 9/2018 | Liu et al. |
| 10,113,163 B2 | 10/2018 | Liu et al. |
| 10,167,457 B2 | 1/2019 | Liu et al. |
| 10,227,581 B2 | 3/2019 | Liu et al. |
| 10,323,236 B2 | 6/2019 | Liu et al. |
| 10,465,176 B2 | 11/2019 | Liu et al. |
| 10,508,298 B2 | 12/2019 | Liu et al. |
| 10,597,679 B2 | 3/2020 | Liu et al. |
| 10,682,410 B2 | 6/2020 | Liu et al. |
| 10,704,062 B2 | 7/2020 | Liu et al. |
| 10,745,677 B2 | 8/2020 | Liu et al. |
| 2003/0082575 A1 | 5/2003 | Schultz et al. |
| 2003/0108885 A1 | 6/2003 | Schultz et al. |
| 2004/0003420 A1 | 1/2004 | Kuhn et al. |
| 2004/0115184 A1 | 6/2004 | Smith et al. |
| 2005/0222030 A1 | 10/2005 | Allison |
| 2006/0088864 A1 | 4/2006 | Smolke et al. |
| 2006/0104984 A1 | 5/2006 | Littlefield et al. |
| 2006/0246568 A1 | 11/2006 | Honjo et al. |
| 2007/0264692 A1 | 11/2007 | Liu et al. |
| 2008/0051317 A1 | 2/2008 | Church et al. |
| 2008/0124725 A1 | 5/2008 | Barrangou et al. |
| 2008/0182254 A1 | 7/2008 | Hall et al. |
| 2009/0130718 A1 | 5/2009 | Short |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0316643 A1 | 12/2010 | Eckert et al. |
| 2011/0059160 A1 | 3/2011 | Essner et al. |
| 2011/0104787 A1 | 5/2011 | Church et al. |
| 2011/0189776 A1 | 8/2011 | Terns et al. |
| 2011/0217739 A1 | 9/2011 | Terns et al. |
| 2011/0301073 A1 | 12/2011 | Gregory et al. |
| 2012/0129759 A1 | 5/2012 | Liu et al. |
| 2012/0141523 A1 | 6/2012 | Castado et al. |
| 2012/0244264 A1 | 9/2012 | Karpinsky et al. |
| 2012/0244601 A1 | 9/2012 | Bertozzi et al. |
| 2012/0270273 A1 | 10/2012 | Zhang et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0309720 A1 | 11/2013 | Schultz et al. |
| 2013/0344117 A1 | 12/2013 | Mirosevich et al. |
| 2014/0004280 A1 | 1/2014 | Loomis |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0141094 A1 | 5/2014 | Smyth et al. |
| 2014/0141487 A1 | 5/2014 | Feldman et al. |
| 2014/0179770 A1 | 6/2014 | Zhang et al. |
| 2014/0186843 A1 | 7/2014 | Zhang et al. |
| 2014/0186958 A1 | 7/2014 | Zhang et al. |
| 2014/0234289 A1 | 8/2014 | Liu et al. |
| 2014/0248702 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0079681 A1 | 3/2015 | Zhang |
| 2015/0098954 A1 | 4/2015 | Hyde et al. |
| 2015/0118216 A1 | 4/2015 | Liu et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens |
| 2015/0218573 A1 | 8/2015 | Loque et al. |
| 2015/0225773 A1 | 8/2015 | Farmer et al. |
| 2015/0252358 A1 | 9/2015 | Maeder et al. |
| 2015/0307889 A1 | 10/2015 | Petolino et al. |
| 2015/0315252 A1 | 11/2015 | Haugwitz et al. |
| 2016/0015682 A2 | 1/2016 | Cawthorne et al. |

(56) References Cited

U.S. PATENT DOCUMENTS

| | | |
|---|---|---|
| 2016/0017393 A1 | 1/2016 | Jacobson et al. |
| 2016/0017396 A1 | 1/2016 | Cann et al. |
| 2016/0032292 A1 | 2/2016 | Storici et al. |
| 2016/0032353 A1 | 2/2016 | Braman et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0115488 A1 | 4/2016 | Zhang et al. |
| 2016/0138046 A1 | 5/2016 | Wu |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0272965 A1 | 9/2016 | Zhang et al. |
| 2016/0281072 A1 | 9/2016 | Zhang |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0333389 A1 | 11/2016 | Liu et al. |
| 2016/0340662 A1 | 11/2016 | Zhang et al. |
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0350476 A1 | 12/2016 | Quake et al. |
| 2016/0369262 A1 | 12/2016 | Reik et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0037432 A1 | 2/2017 | Donohoue et al. |
| 2017/0044520 A1 | 2/2017 | Liu et al. |
| 2017/0044592 A1 | 2/2017 | Peter et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0073670 A1 | 3/2017 | Nishida et al. |
| 2017/0087224 A1 | 3/2017 | Quake |
| 2017/0087225 A1 | 3/2017 | Quake |
| 2017/0088587 A1 | 3/2017 | Quake |
| 2017/0088828 A1 | 3/2017 | Quake |
| 2017/0107536 A1 | 4/2017 | Zhang et al. |
| 2017/0107560 A1 | 4/2017 | Peter et al. |
| 2017/0114367 A1 | 4/2017 | Hu et al. |
| 2017/0121693 A1 | 5/2017 | Liu et al. |
| 2017/0145394 A1 | 5/2017 | Yeo et al. |
| 2017/0145405 A1 | 5/2017 | Tang et al. |
| 2017/0145438 A1 | 5/2017 | Kantor |
| 2017/0152528 A1 | 6/2017 | Zhang |
| 2017/0152787 A1 | 6/2017 | Kubo et al. |
| 2017/0159033 A1 | 6/2017 | Kamtekar et al. |
| 2017/0166928 A1 | 6/2017 | Vyas et al. |
| 2017/0175104 A1 | 6/2017 | Doudna et al. |
| 2017/0175142 A1 | 6/2017 | Zhang et al. |
| 2017/0191047 A1 | 7/2017 | Terns et al. |
| 2017/0191078 A1 | 7/2017 | Zhang et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0226522 A1 | 8/2017 | Hu et al. |
| 2017/0233703 A1 | 8/2017 | Xie et al. |
| 2017/0233756 A1 | 8/2017 | Begemann et al. |
| 2017/0247671 A1 | 8/2017 | Yung et al. |
| 2017/0247703 A1 | 8/2017 | Sloan et al. |
| 2017/0268022 A1 | 9/2017 | Liu et al. |
| 2017/0283797 A1 | 10/2017 | Robb et al. |
| 2017/0314016 A1 | 11/2017 | Kim et al. |
| 2017/0362635 A1 | 12/2017 | Chamberlain et al. |
| 2018/0064077 A1 | 3/2018 | Dunham et al. |
| 2018/0066258 A1 | 3/2018 | Powell |
| 2018/0068062 A1 | 3/2018 | Zhang et al. |
| 2018/0073012 A1 | 3/2018 | Liu et al. |
| 2018/0100147 A1 | 4/2018 | Yates et al. |
| 2018/0105867 A1 | 4/2018 | Xiao et al. |
| 2018/0119118 A1 | 5/2018 | Lu et al. |
| 2018/0127780 A1 | 5/2018 | Liu et al. |
| 2018/0155708 A1 | 6/2018 | Church et al. |
| 2018/0155720 A1 | 6/2018 | Donohoue et al. |
| 2018/0163213 A1 | 6/2018 | Aneja et al. |
| 2018/0170984 A1 | 6/2018 | Harris et al. |
| 2018/0179503 A1 | 6/2018 | Maianti et al. |
| 2018/0179547 A1 | 6/2018 | Zhang et al. |
| 2018/0201921 A1 | 7/2018 | Malcolm |
| 2018/0230464 A1 | 8/2018 | Zhong |
| 2018/0230471 A1 | 8/2018 | Storici et al. |
| 2018/0236081 A1 | 8/2018 | Liu et al. |
| 2018/0237787 A1 | 8/2018 | Maianti et al. |
| 2018/0245066 A1 | 8/2018 | Yao et al. |
| 2018/0265864 A1 | 9/2018 | Li et al. |
| 2018/0273939 A1 | 9/2018 | Yu et al. |
| 2018/0282722 A1 | 10/2018 | Jakimo et al. |
| 2018/0305688 A1 | 10/2018 | Zhong |
| 2018/0305704 A1 | 10/2018 | Zhang |
| 2018/0312825 A1 | 11/2018 | Liu et al. |
| 2018/0312828 A1 | 11/2018 | Liu et al. |
| 2018/0312835 A1 | 11/2018 | Yao et al. |
| 2018/0327756 A1 | 11/2018 | Zhang et al. |
| 2019/0093099 A1 | 3/2019 | Liu et al. |
| 2019/0185883 A1 | 6/2019 | Liu et al. |
| 2019/0225955 A1 | 7/2019 | Liu et al. |
| 2019/0233847 A1 | 8/2019 | Savage et al. |
| 2019/0322992 A1 | 10/2019 | Liu et al. |
| 2019/0352632 A1 | 11/2019 | Liu et al. |
| 2019/0367891 A1 | 12/2019 | Liu et al. |
| 2020/0010818 A1 | 1/2020 | Liu et al. |
| 2020/0010835 A1 | 1/2020 | Maianti et al. |
| 2020/0063127 A1 | 2/2020 | Lu et al. |
| 2020/0172931 A1 | 6/2020 | Liu et al. |
| 2020/0181619 A1 | 6/2020 | Liu et al. |
| 2020/0190493 A1 | 6/2020 | Liu et al. |

FOREIGN PATENT DOCUMENTS

| | | |
|---|---|---|
| AU | 2015101792 A4 | 1/2016 |
| BR | 112015013786 A2 | 7/2017 |
| CA | 2894668 A1 | 6/2014 |
| CA | 2894681 A1 | 6/2014 |
| CA | 2894684 A1 | 6/2014 |
| CA | 2 852 593 A1 | 11/2015 |
| CN | 1069962 A | 3/1993 |
| CN | 103224947 A | 7/2013 |
| CN | 103233028 A | 8/2013 |
| CN | 103388006 A | 11/2013 |
| CN | 103614415 A | 3/2014 |
| CN | 103642836 A | 3/2014 |
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 103981211 A | 8/2014 |
| CN | 103981212 A | 8/2014 |
| CN | 104004778 | 8/2014 |
| CN | 104004782 A | 8/2014 |
| CN | 104017821 A | 9/2014 |
| CN | 104109687 A | 10/2014 |
| CN | 104178461 A | 12/2014 |
| CN | 104342457 A | 2/2015 |

(56) References Cited

FOREIGN PATENT DOCUMENTS

| | | |
|---|---|---|
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |
| CN | 104531705 A | 4/2015 |
| CN | 104560864 A | 4/2015 |
| CN | 104561095 A | 4/2015 |
| CN | 104593418 A | 5/2015 |
| CN | 104593422 A | 5/2015 |
| CN | 104611370 A | 5/2015 |
| CN | 104651392 A | 5/2015 |
| CN | 104651398 A | 5/2015 |
| CN | 104651399 A | 5/2015 |
| CN | 104651401 A | 5/2015 |
| CN | 104673816 A | 6/2015 |
| CN | 104725626 A | 6/2015 |
| CN | 104726449 A | 6/2015 |
| CN | 104726494 A | 6/2015 |
| CN | 104745626 A | 7/2015 |
| CN | 104762321 A | 7/2015 |
| CN | 104805078 A | 7/2015 |
| CN | 104805099 A | 7/2015 |
| CN | 104805118 A | 7/2015 |
| CN | 104846010 A | 8/2015 |
| CN | 104894068 A | 9/2015 |
| CN | 104894075 A | 9/2015 |
| CN | 104928321 A | 9/2015 |
| CN | 105039339 A | 11/2015 |
| CN | 105039399 A | 11/2015 |
| CN | 105063061 A | 11/2015 |
| CN | 105087620 A | 11/2015 |
| CN | 105112422 A | 12/2015 |
| CN | 105112445 A | 12/2015 |
| CN | 105112519 A | 12/2015 |
| CN | 105121648 A | 12/2015 |
| CN | 105132427 A | 12/2015 |
| CN | 105132451 A | 12/2015 |
| CN | 105177038 A | 12/2015 |
| CN | 105177126 A | 12/2015 |
| CN | 105210981 A | 1/2016 |
| CN | 105219799 A | 1/2016 |
| CN | 105238806 A | 1/2016 |
| CN | 105255937 A | 1/2016 |
| CN | 105274144 A | 1/2016 |
| CN | 105296518 A | 2/2016 |
| CN | 105296537 A | 2/2016 |
| CN | 105316324 A | 2/2016 |
| CN | 105316327 A | 2/2016 |
| CN | 105316337 A | 2/2016 |
| CN | 105331607 A | 2/2016 |
| CN | 105331608 A | 2/2016 |
| CN | 105331609 A | 2/2016 |
| CN | 105331627 A | 2/2016 |
| CN | 105400773 A | 3/2016 |
| CN | 105400779 A | 3/2016 |
| CN | 105400810 A | 3/2016 |
| CN | 105441451 A | 3/2016 |
| CN | 105462968 A | 4/2016 |
| CN | 105463003 A | 4/2016 |
| CN | 105463027 A | 4/2016 |
| CN | 105492608 A | 4/2016 |
| CN | 105492609 A | 4/2016 |
| CN | 105505976 A | 4/2016 |
| CN | 105505979 A | 4/2016 |
| CN | 105518134 A | 4/2016 |
| CN | 105518135 A | 4/2016 |
| CN | 105518137 A | 4/2016 |
| CN | 105518138 A | 4/2016 |
| CN | 105518139 A | 4/2016 |
| CN | 105518140 A | 4/2016 |
| CN | 105543228 A | 5/2016 |
| CN | 105543266 A | 5/2016 |
| CN | 105543270 A | 5/2016 |
| CN | 105567688 A | 5/2016 |
| CN | 105567689 A | 5/2016 |
| CN | 105567734 A | 5/2016 |
| CN | 105567735 A | 5/2016 |
| CN | 105567738 A | 5/2016 |
| CN | 105593367 A | 5/2016 |
| CN | 105594664 A | 5/2016 |
| CN | 105602987 A | 5/2016 |
| CN | 105624146 A | 6/2016 |
| CN | 105624187 A | 6/2016 |
| CN | 105646719 A | 6/2016 |
| CN | 105647922 A | 6/2016 |
| CN | 105647962 A | 6/2016 |
| CN | 105647968 A | 6/2016 |
| CN | 105647969 A | 6/2016 |
| CN | 105671070 A | 6/2016 |
| CN | 105671083 A | 6/2016 |
| CN | 105695485 A | 6/2016 |
| CN | 105779448 A | 7/2016 |
| CN | 105779449 A | 7/2016 |
| CN | 105802980 A | 7/2016 |
| CN | 105821039 A | 8/2016 |
| CN | 105821040 A | 8/2016 |
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |
| CN | 106011104 A | 10/2016 |
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |

(56) References Cited

FOREIGN PATENT DOCUMENTS

| | | |
|---|---|---|
| CN | 106222203 A | 12/2016 |
| CN | 106244555 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |
| CN | 106434663 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480080 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 4/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755091 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |
| CN | 107099533 A | 8/2017 |
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142272 A | 9/2017 |
| CN | 107142282 A | 9/2017 |
| CN | 107177591 A | 9/2017 |
| CN | 107177595 A | 9/2017 |
| CN | 107177631 A | 9/2017 |
| CN | 107190006 A | 9/2017 |
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| CN | 107304435 A | 10/2017 |
| CN | 107312785 A | 11/2017 |
| CN | 107312793 A | 11/2017 |
| CN | 107312795 A | 11/2017 |
| CN | 107312798 A | 11/2017 |
| CN | 107326042 A | 11/2017 |
| CN | 107326046 A | 11/2017 |
| CN | 107354156 A | 11/2017 |
| CN | 107354173 A | 11/2017 |
| CN | 107356793 A | 11/2017 |
| CN | 107362372 A | 11/2017 |
| CN | 107365786 A | 11/2017 |
| CN | 107365804 A | 11/2017 |
| CN | 107384894 A | 11/2017 |
| CN | 107384922 A | 11/2017 |
| CN | 107384926 A | 11/2017 |
| CN | 107400677 A | 11/2017 |
| CN | 107418974 A | 12/2017 |
| CN | 107435051 A | 12/2017 |
| CN | 107435069 A | 12/2017 |
| CN | 107446922 A | 12/2017 |
| CN | 107446923 A | 12/2017 |
| CN | 107446924 A | 12/2017 |
| CN | 107446932 A | 12/2017 |
| CN | 107446951 A | 12/2017 |
| CN | 107446954 A | 12/2017 |
| CN | 107460196 A | 12/2017 |
| CN | 107474129 A | 12/2017 |
| CN | 107475300 A | 12/2017 |
| CN | 107488649 A | 12/2017 |
| CN | 107502608 A | 12/2017 |
| CN | 107502618 A | 12/2017 |
| CN | 107513531 A | 12/2017 |
| CN | 107519492 A | 12/2017 |
| CN | 107523567 A | 12/2017 |
| CN | 107523583 A | 12/2017 |
| CN | 107541525 A | 1/2018 |
| CN | 107557373 A | 1/2018 |
| CN | 107557378 A | 1/2018 |
| CN | 107557381 A | 1/2018 |

(56) References Cited

FOREIGN PATENT DOCUMENTS

| | | |
|---|---|---|
| CN | 107557390 A | 1/2018 |
| CN | 107557393 A | 1/2018 |
| CN | 107557394 A | 1/2018 |
| CN | 107557455 A | 1/2018 |
| CN | 107574179 | 1/2018 |
| CN | 107586777 | 1/2018 |
| CN | 107586779 | 1/2018 |
| CN | 107604003 | 1/2018 |
| CN | 107619829 A | 1/2018 |
| CN | 107619837 A | 1/2018 |
| CN | 107630006 A | 1/2018 |
| CN | 107630041 A | 1/2018 |
| CN | 107630042 A | 1/2018 |
| CN | 107630043 A | 1/2018 |
| CN | 107641631 A | 1/2018 |
| CN | 107653256 A | 2/2018 |
| CN | 107686848 A | 2/2018 |
| CN | 206970581 | 2/2018 |
| CN | 107760652 A | 3/2018 |
| CN | 107760663 A | 3/2018 |
| CN | 107760684 A | 3/2018 |
| CN | 107760715 A | 3/2018 |
| CN | 107784200 A | 3/2018 |
| CN | 107794272 A | 3/2018 |
| CN | 107794276 A | 3/2018 |
| CN | 107815463 A | 3/2018 |
| CN | 107828738 A | 3/2018 |
| CN | 107828794 A | 3/2018 |
| CN | 107828826 A | 3/2018 |
| CN | 107828874 A | 3/2018 |
| CN | 107858346 A | 3/2018 |
| CN | 107858373 A | 3/2018 |
| CN | 107880132 A | 4/2018 |
| CN | 107881184 A | 4/2018 |
| CN | 107893074 A | 4/2018 |
| CN | 107893075 A | 4/2018 |
| CN | 107893076 A | 4/2018 |
| CN | 107893080 A | 4/2018 |
| CN | 107893086 A | 4/2018 |
| CN | 107904261 A | 4/2018 |
| CN | 107937427 A | 4/2018 |
| CN | 107937432 A | 4/2018 |
| CN | 107937501 A | 4/2018 |
| CN | 107974466 A | 5/2018 |
| CN | 107988229 A | 5/2018 |
| CN | 107988246 A | 5/2018 |
| CN | 107988256 A | 5/2018 |
| CN | 107988268 A | 5/2018 |
| CN | 108018316 A | 5/2018 |
| CN | 108034656 A | 5/2018 |
| CN | 108048466 A | 5/2018 |
| CN | 108102940 A | 6/2018 |
| CN | 108103092 A | 6/2018 |
| CN | 108103098 A | 6/2018 |
| CN | 108103586 A | 6/2018 |
| CN | 108148835 A | 6/2018 |
| CN | 108148837 A | 6/2018 |
| CN | 108148873 A | 6/2018 |
| CN | 108192956 A | 6/2018 |
| CN | 108251423 A | 7/2018 |
| CN | 108251451 A | 7/2018 |
| CN | 108251452 A | 7/2018 |
| CN | 108342480 A | 7/2018 |
| CN | 108359691 A | 8/2018 |
| CN | 108359712 A | 8/2018 |
| CN | 108384784 A | 8/2018 |
| CN | 108396027 A | 8/2018 |
| CN | 108410877 A | 8/2018 |
| CN | 108410906 A | 8/2018 |
| CN | 108410907 A | 8/2018 |
| CN | 108410911 A | 8/2018 |
| CN | 108424931 A | 8/2018 |
| CN | 108441519 A | 8/2018 |
| CN | 108441520 A | 8/2018 |
| CN | 108486108 A | 9/2018 |
| CN | 108486111 A | 9/2018 |
| CN | 108486145 A | 9/2018 |
| CN | 108486146 A | 9/2018 |
| CN | 108486154 A | 9/2018 |
| CN | 108486159 A | 9/2018 |
| CN | 108486234 A | 9/2018 |
| CN | 108504657 A | 9/2018 |
| CN | 108504685 A | 9/2018 |
| CN | 108504693 A | 9/2018 |
| CN | 108546712 A | 9/2018 |
| CN | 108546717 A | 9/2018 |
| CN | 108546718 A | 9/2018 |
| CN | 108559730 A | 9/2018 |
| CN | 108559732 A | 9/2018 |
| CN | 108559745 A | 9/2018 |
| CN | 108559760 A | 9/2018 |
| CN | 108570479 A | 9/2018 |
| CN | 108588071 A | 9/2018 |
| CN | 108588123 A | 9/2018 |
| CN | 108588128 A | 9/2018 |
| CN | 108588182 A | 9/2018 |
| CN | 108610399 A | 10/2018 |
| CN | 108611364 A | 10/2018 |
| CN | 108624622 A | 10/2018 |
| CN | 108642053 A | 10/2018 |
| CN | 108642055 A | 10/2018 |
| CN | 108642077 A | 10/2018 |
| CN | 108642078 A | 10/2018 |
| CN | 108642090 A | 10/2018 |
| CN | 108690844 A | 10/2018 |
| CN | 108707604 A | 10/2018 |
| CN | 108707620 A | 10/2018 |
| CN | 108707621 A | 10/2018 |
| CN | 108707628 A | 10/2018 |
| CN | 108707629 A | 10/2018 |
| CN | 108715850 A | 10/2018 |
| CN | 108728476 A | 11/2018 |
| CN | 108728486 A | 11/2018 |
| CN | 108753772 A | 11/2018 |
| CN | 108753783 A | 11/2018 |
| CN | 108753813 A | 11/2018 |
| CN | 108753817 A | 11/2018 |
| CN | 108753832 A | 11/2018 |
| CN | 108753835 A | 11/2018 |
| CN | 108753836 A | 11/2018 |
| CN | 108795902 A | 11/2018 |
| CN | 108822217 A | 11/2018 |
| CN | 108823248 A | 11/2018 |
| CN | 108823249 A | 11/2018 |
| CN | 108823291 A | 11/2018 |
| CN | 108841845 A | 11/2018 |
| CN | 108853133 A | 11/2018 |
| CN | 108866093 A | 11/2018 |
| CN | 108893529 A | 11/2018 |
| CN | 108913664 A | 11/2018 |
| CN | 108913691 A | 11/2018 |
| CN | 108913714 A | 11/2018 |
| CN | 108913717 A | 11/2018 |
| EP | 2604255 A1 | 6/2013 |
| EP | 2840140 A1 | 2/2015 |
| EP | 2966170 A1 | 1/2016 |
| EP | 3009511 A2 | 4/2016 |
| EP | 3031921 A1 | 6/2016 |
| EP | 3045537 A1 | 7/2016 |
| EP | 3 115 457 A | 1/2017 |
| EP | 3144390 A1 | 3/2017 |
| EP | 3199632 A1 | 8/2017 |
| EP | 3216867 A1 | 9/2017 |
| EP | 3252160 A1 | 12/2017 |
| GB | 2528177 A | 1/2016 |
| GB | 2531454 A | 4/2016 |
| GB | 2542653 A | 3/2017 |
| HK | 1208045 A1 | 2/2016 |
| JP | 2007-501626 A | 2/2007 |
| JP | 2008-515405 A | 5/2008 |
| JP | 2010-539929 A | 12/2010 |
| JP | 2011-081011 A | 4/2011 |
| JP | 2011-523353 A | 8/2011 |
| JP | 2012-525146 A | 10/2012 |

(56) References Cited

FOREIGN PATENT DOCUMENTS

| | | |
|---|---|---|
| JP | 2012-531909 A | 12/2012 |
| KR | 101584933 B1 | 1/2016 |
| KR | 20160133380 A | 11/2016 |
| KR | 20170037025 A | 4/2017 |
| KR | 20170037028 A | 4/2017 |
| KR | 101748575 B1 | 6/2017 |
| KR | 2018-0022465 A | 3/2018 |
| RU | 2016104674 A | 8/2017 |
| RU | 2634395 C1 | 10/2017 |
| RU | 2652899 C1 | 5/2018 |
| RU | 2015128057 A | 3/2019 |
| RU | 2015128098 A | 3/2019 |
| RU | 2687451 C1 | 5/2019 |
| RU | 2019112514 A | 6/2019 |
| RU | 2019127300 A | 9/2019 |
| RU | 2701850 C2 | 10/2019 |
| TW | I608100 B | 12/2017 |
| TW | 2018-29773 A | 8/2018 |
| WO | WO 2001/036452 A2 | 5/2001 |
| WO | WO 2001/038547 A2 | 5/2001 |
| WO | WO 2002/059296 A2 | 8/2002 |
| WO | WO 2002/068676 A2 | 9/2002 |
| WO | WO 2002/103028 A2 | 12/2002 |
| WO | WO 2004/007684 A2 | 1/2004 |
| WO | WO 2005/014791 A2 | 2/2005 |
| WO | WO 2005/019415 A2 | 3/2005 |
| WO | WO 2006/002547 A1 | 1/2006 |
| WO | WO 2006/042112 A2 | 4/2006 |
| WO | WO 2007/025097 A2 | 3/2007 |
| WO | WO 2007/136815 A2 | 11/2007 |
| WO | WO 2007/143574 A1 | 12/2007 |
| WO | WO 2008/108989 A2 | 9/2008 |
| WO | WO 2009/134808 A2 | 11/2009 |
| WO | WO 2010/011961 A2 | 1/2010 |
| WO | WO 2010/054108 A2 | 5/2010 |
| WO | WO 2010/054154 A2 | 5/2010 |
| WO | WO 2010/068289 A2 | 6/2010 |
| WO | WO 2010/075424 A2 | 7/2010 |
| WO | WO 2010/102257 A2 | 9/2010 |
| WO | WO 2010/129019 A2 | 11/2010 |
| WO | WO 2010/129023 A2 | 11/2010 |
| WO | WO 2010/132092 A2 | 11/2010 |
| WO | WO 2010/144150 A2 | 12/2010 |
| WO | WO 2011/002503 A1 | 1/2011 |
| WO | WO 2011/017293 A2 | 2/2011 |
| WO | WO 2011/053868 A1 | 5/2011 |
| WO | WO 2011/053982 A2 | 5/2011 |
| WO | WO 2011/075627 A1 | 6/2011 |
| WO | WO 2011/091311 A2 | 7/2011 |
| WO | WO 2011/109031 A1 | 9/2011 |
| WO | WO 2011/143124 A2 | 11/2011 |
| WO | WO 2011/159369 A1 | 12/2011 |
| WO | WO 2012/054726 A1 | 4/2012 |
| WO | WO 2012/065043 A2 | 5/2012 |
| WO | WO 2012/125445 A2 | 9/2012 |
| WO | WO 2012/138927 A2 | 10/2012 |
| WO | WO 2012/149470 A1 | 11/2012 |
| WO | WO 2012/158985 A2 | 11/2012 |
| WO | WO 2012/158986 A2 | 11/2012 |
| WO | WO 2012/164565 A1 | 12/2012 |
| WO | WO 2013/012674 A1 | 1/2013 |
| WO | WO 2013/013105 A2 | 1/2013 |
| WO | WO 2013/047844 A1 | 4/2013 |
| WO | WO 2013/066438 A2 | 5/2013 |
| WO | WO 2013/098244 A1 | 7/2013 |
| WO | WO 2013/119602 A1 | 8/2013 |
| WO | WO 2013/126794 A1 | 8/2013 |
| WO | WO 2013/130824 A1 | 9/2013 |
| WO | WO 2013/141680 A1 | 9/2013 |
| WO | WO 2013/142578 A1 | 9/2013 |
| WO | WO 2013/152359 A1 | 10/2013 |
| WO | WO 2013/160230 A1 | 10/2013 |
| WO | WO 2013/166315 A1 | 11/2013 |
| WO | WO 2013/169398 A2 | 11/2013 |
| WO | WO 2013/169802 A1 | 11/2013 |
| WO | WO 2013/176772 A1 | 11/2013 |
| WO | WO 2013/176915 A1 | 11/2013 |
| WO | WO 2013/176916 A1 | 11/2013 |
| WO | WO 2013/181440 A1 | 12/2013 |
| WO | WO 2013/186754 A2 | 12/2013 |
| WO | WO 2013/188037 A2 | 12/2013 |
| WO | WO 2013/188522 A2 | 12/2013 |
| WO | WO 2013/188638 A2 | 12/2013 |
| WO | WO 2013/192278 A1 | 12/2013 |
| WO | WO 2013/142378 A9 | 1/2014 |
| WO | WO 2014/005042 A2 | 1/2014 |
| WO | WO 2014/011237 A1 | 1/2014 |
| WO | WO 2014/011901 A2 | 1/2014 |
| WO | WO 2014/018423 A2 | 1/2014 |
| WO | WO 2014/020608 A1 | 2/2014 |
| WO | WO 2014/022120 A2 | 2/2014 |
| WO | WO 2014/022702 A2 | 2/2014 |
| WO | WO 2014/036219 A2 | 3/2014 |
| WO | WO 2014/039513 A2 | 3/2014 |
| WO | WO 2014/039523 A1 | 3/2014 |
| WO | WO 2014/039585 A2 | 3/2014 |
| WO | WO 2014/039684 A1 | 3/2014 |
| WO | WO 2014/039692 A2 | 3/2014 |
| WO | WO 2014/039702 A2 | 3/2014 |
| WO | WO 2014/039872 A1 | 3/2014 |
| WO | WO 2014/039970 A1 | 3/2014 |
| WO | WO 2014/041327 A1 | 3/2014 |
| WO | WO 2014/043143 A1 | 3/2014 |
| WO | WO 2014/047103 A2 | 3/2014 |
| WO | WO 2014/059173 A2 | 4/2014 |
| WO | WO 2014/059255 A1 | 4/2014 |
| WO | WO 2014/065596 A1 | 5/2014 |
| WO | WO 2014/066505 A1 | 5/2014 |
| WO | WO 2014/068346 A2 | 5/2014 |
| WO | WO 2014/070887 A1 | 5/2014 |
| WO | WO 2014/071006 A1 | 5/2014 |
| WO | WO 2014/071219 A1 | 5/2014 |
| WO | WO 2014/071235 A1 | 5/2014 |
| WO | WO 2014/072941 A1 | 5/2014 |
| WO | WO 2014/081729 A1 | 5/2014 |
| WO | WO 2014/081730 A1 | 5/2014 |
| WO | WO 2014/081855 A1 | 5/2014 |
| WO | WO 2014/082644 A1 | 6/2014 |
| WO | WO 2014/085261 A1 | 6/2014 |
| WO | WO 2014/085593 A1 | 6/2014 |
| WO | WO 2014/085830 A2 | 6/2014 |
| WO | WO 2014/089212 A1 | 6/2014 |
| WO | WO 2014/089290 A1 | 6/2014 |
| WO | WO 2014/089348 A1 | 6/2014 |
| WO | WO 2014/089513 A1 | 6/2014 |
| WO | WO 2014/089533 A2 | 6/2014 |
| WO | WO 2014/089541 A2 | 6/2014 |
| WO | WO 2014/093479 A1 | 6/2014 |
| WO | WO 2014/093595 A1 | 6/2014 |
| WO | WO 2014/093622 A2 | 6/2014 |
| WO | WO 2014/093635 A1 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/093736 A1 | 6/2014 |
| WO | WO 2014/093768 A1 | 6/2014 |
| WO | WO 2014/093852 A1 | 6/2014 |
| WO | WO 2014/096972 A2 | 6/2014 |
| WO | WO 2014/099744 A1 | 6/2014 |
| WO | WO 2014/099750 A2 | 6/2014 |
| WO | WO 2014/104878 A1 | 7/2014 |
| WO | WO 2014/110006 A1 | 7/2014 |
| WO | WO 2014/110552 A1 | 7/2014 |
| WO | WO 2014/113493 A1 | 7/2014 |
| WO | WO 2014/123967 A2 | 8/2014 |
| WO | WO 2014/124226 A1 | 8/2014 |
| WO | WO 2014/125668 A1 | 8/2014 |
| WO | WO 2014/127287 A1 | 8/2014 |
| WO | WO 2014/128324 A1 | 8/2014 |
| WO | WO 2014/128659 A1 | 8/2014 |

(56) References Cited

FOREIGN PATENT DOCUMENTS

| | | |
|---|---|---|
| WO | WO 2014/130706 A1 | 8/2014 |
| WO | WO 2014/130955 A1 | 8/2014 |
| WO | WO 2014/131833 A1 | 9/2014 |
| WO | WO 2014/138379 A1 | 9/2014 |
| WO | WO 2014/143381 A1 | 9/2014 |
| WO | WO 2014/144094 A1 | 9/2014 |
| WO | WO 2014/144155 A1 | 9/2014 |
| WO | WO 2014/144288 A1 | 9/2014 |
| WO | WO 2014/144592 A2 | 9/2014 |
| WO | WO 2014/144761 A2 | 9/2014 |
| WO | WO 2014/144951 A1 | 9/2014 |
| WO | WO 2014/145599 A2 | 9/2014 |
| WO | WO 2014/145736 A2 | 9/2014 |
| WO | WO 2014/150624 A1 | 9/2014 |
| WO | WO 2014/152432 A2 | 9/2014 |
| WO | WO 2014/153118 A1 | 9/2014 |
| WO | WO 2014/153470 A2 | 9/2014 |
| WO | WO 2014/161821 A1 | 10/2014 |
| WO | WO 2014/164466 A1 | 10/2014 |
| WO | WO 2014/165177 A1 | 10/2014 |
| WO | WO 2014/165349 A1 | 10/2014 |
| WO | WO 2014/165612 A2 | 10/2014 |
| WO | WO 2014/165707 A2 | 10/2014 |
| WO | WO 2014/165825 A2 | 10/2014 |
| WO | WO 2014/172458 A1 | 10/2014 |
| WO | WO 2014/172470 A2 | 10/2014 |
| WO | WO 2014/172489 A2 | 10/2014 |
| WO | WO 2014/173955 A1 | 10/2014 |
| WO | WO 2014/182700 A1 | 11/2014 |
| WO | WO 2014/183071 A2 | 11/2014 |
| WO | WO 2014/184143 A1 | 11/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/186686 A2 | 11/2014 |
| WO | WO 2014/190181 A1 | 11/2014 |
| WO | WO 2014/191128 A1 | 12/2014 |
| WO | WO 2014/191518 A1 | 12/2014 |
| WO | WO 2014/191521 A2 | 12/2014 |
| WO | WO 2014/191525 A1 | 12/2014 |
| WO | WO 2014/191527 A1 | 12/2014 |
| WO | WO 2014/193583 A2 | 12/2014 |
| WO | WO 2014/194190 A1 | 12/2014 |
| WO | WO 2014/197568 A2 | 12/2014 |
| WO | WO 2014/197748 A2 | 12/2014 |
| WO | WO 2014/199358 A1 | 12/2014 |
| WO | WO 2014/200659 A1 | 12/2014 |
| WO | WO 2014/201015 A2 | 12/2014 |
| WO | WO 2014/204578 A1 | 12/2014 |
| WO | WO 2014/204723 A1 | 12/2014 |
| WO | WO 2014/204724 A1 | 12/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |
| WO | WO 2014/205192 A2 | 12/2014 |
| WO | WO 2014/207043 A1 | 12/2014 |
| WO | WO 2015/002780 A1 | 1/2015 |
| WO | WO 2015/004241 A2 | 1/2015 |
| WO | WO 2015/006290 A1 | 1/2015 |
| WO | WO 2015/006294 A2 | 1/2015 |
| WO | WO 2015/006437 A1 | 1/2015 |
| WO | WO 2015/006498 A2 | 1/2015 |
| WO | WO 2015/006747 A2 | 1/2015 |
| WO | WO 2015/007194 A1 | 1/2015 |
| WO | WO 2015/010114 A1 | 1/2015 |
| WO | WO 2015/011483 A1 | 1/2015 |
| WO | WO 2015/013583 A2 | 1/2015 |
| WO | WO 2015/017866 A1 | 2/2015 |
| WO | WO 2015/018503 A1 | 2/2015 |
| WO | WO 2015/021353 A1 | 2/2015 |
| WO | WO 2015/021426 A1 | 2/2015 |
| WO | WO 2015/021990 A1 | 2/2015 |
| WO | WO 2015/024017 A2 | 2/2015 |
| WO | WO 2015/024986 A1 | 2/2015 |
| WO | WO 2015/026883 A1 | 2/2015 |
| WO | WO 2015/026885 A1 | 2/2015 |
| WO | WO 2015/026886 A1 | 2/2015 |
| WO | WO 2015/026887 A1 | 2/2015 |
| WO | WO 2015/027134 A1 | 2/2015 |
| WO | WO 2015/028969 A2 | 3/2015 |
| WO | WO 2015/030881 A1 | 3/2015 |
| WO | WO 2015/031619 A1 | 3/2015 |
| WO | WO 2015/031775 A1 | 3/2015 |
| WO | WO 2015/032494 A2 | 3/2015 |
| WO | WO 2015/033293 A1 | 3/2015 |
| WO | WO 2015/034872 A2 | 3/2015 |
| WO | WO 2015/034885 A1 | 3/2015 |
| WO | WO 2015/035136 A2 | 3/2015 |
| WO | WO 2015/035139 A2 | 3/2015 |
| WO | WO 2015/035162 A2 | 3/2015 |
| WO | WO 2015/040075 A1 | 3/2015 |
| WO | WO 2015/040402 A1 | 3/2015 |
| WO | WO 2015/042585 A1 | 3/2015 |
| WO | WO 2015/048577 A2 | 4/2015 |
| WO | WO 2015/048690 A1 | 4/2015 |
| WO | WO 2015/048707 A2 | 4/2015 |
| WO | WO 2015/048801 A2 | 4/2015 |
| WO | WO 2015/049897 A1 | 4/2015 |
| WO | WO 2015/051191 A1 | 4/2015 |
| WO | WO 2015/052133 A1 | 4/2015 |
| WO | WO 2015/052231 A2 | 4/2015 |
| WO | WO 2015/052335 A1 | 4/2015 |
| WO | WO 2015/053995 A1 | 4/2015 |
| WO | WO 2015/054253 A1 | 4/2015 |
| WO | WO 2015/054315 A1 | 4/2015 |
| WO | WO 2015/057671 A1 | 4/2015 |
| WO | WO 2015/057834 A1 | 4/2015 |
| WO | WO 2015/057852 A1 | 4/2015 |
| WO | WO 2015/057976 A1 | 4/2015 |
| WO | WO 2015/057980 A1 | 4/2015 |
| WO | WO 2015/059265 A1 | 4/2015 |
| WO | WO 2015/065964 A1 | 5/2015 |
| WO | WO 2015/066119 A1 | 5/2015 |
| WO | WO 2015/066634 A2 | 5/2015 |
| WO | WO 2015/066636 A2 | 5/2015 |
| WO | WO 2015/066637 A1 | 5/2015 |
| WO | WO 2015/066638 A2 | 5/2015 |
| WO | WO 2015/066643 A1 | 5/2015 |
| WO | WO 2015/069682 A2 | 5/2015 |
| WO | WO 2015/070083 A1 | 5/2015 |
| WO | WO 2015/070193 A1 | 5/2015 |
| WO | WO 2015/070212 A1 | 5/2015 |
| WO | WO 2015/071474 A2 | 5/2015 |
| WO | WO 2015/073683 A2 | 5/2015 |
| WO | WO 2015/073867 A1 | 5/2015 |
| WO | WO 2015/073990 A1 | 5/2015 |
| WO | WO 2015/075056 A1 | 5/2015 |
| WO | WO 2015/075154 A2 | 5/2015 |
| WO | WO 2015/075175 A1 | 5/2015 |
| WO | WO 2015/075195 A1 | 5/2015 |
| WO | WO 2015/075557 A2 | 5/2015 |
| WO | WO 2015/077058 A2 | 5/2015 |
| WO | WO 2015/077290 A2 | 5/2015 |
| WO | WO 2015/077318 A1 | 5/2015 |
| WO | WO 2015/079056 A1 | 6/2015 |
| WO | WO 2015/079057 A2 | 6/2015 |
| WO | WO 2015/086795 A1 | 6/2015 |
| WO | WO 2015/086798 A2 | 6/2015 |
| WO | WO 2015/088643 A1 | 6/2015 |
| WO | WO 2015/089046 A1 | 6/2015 |
| WO | WO 2015/089077 A2 | 6/2015 |
| WO | WO 2015/089277 A1 | 6/2015 |
| WO | WO 2015/089351 A1 | 6/2015 |
| WO | WO 2015/089354 A1 | 6/2015 |
| WO | WO 2015/089364 A1 | 6/2015 |
| WO | WO 2015/089406 A1 | 6/2015 |
| WO | WO 2015/089419 A2 | 6/2015 |
| WO | WO 2015/089427 A1 | 6/2015 |
| WO | WO 2015/089462 A1 | 6/2015 |
| WO | WO 2015/089465 A1 | 6/2015 |
| WO | WO 2015/089473 A1 | 6/2015 |
| WO | WO 2015/089486 A2 | 6/2015 |

(56) References Cited

FOREIGN PATENT DOCUMENTS

| | | |
|---|---|---|
| WO | WO 2015/095804 A1 | 6/2015 |
| WO | WO 2015/099850 A1 | 7/2015 |
| WO | WO 2015/100929 A1 | 7/2015 |
| WO | WO 2015/103057 A1 | 7/2015 |
| WO | WO 2015/103153 A1 | 7/2015 |
| WO | WO 2015/105928 A1 | 7/2015 |
| WO | WO 2015/108993 A1 | 7/2015 |
| WO | WO 2015/109752 A1 | 7/2015 |
| WO | WO 2015/110474 A1 | 7/2015 |
| WO | WO 2015/112790 A2 | 7/2015 |
| WO | WO 2015/112896 A2 | 7/2015 |
| WO | WO 2015/113063 A1 | 7/2015 |
| WO | WO 2015/114365 A1 | 8/2015 |
| WO | WO 2015/115903 A1 | 8/2015 |
| WO | WO 2015/116686 A1 | 8/2015 |
| WO | WO 2015/116969 A2 | 8/2015 |
| WO | WO 2015/117021 A1 | 8/2015 |
| WO | WO 2015/117041 A1 | 8/2015 |
| WO | WO 2015/117081 A2 | 8/2015 |
| WO | WO 2015/118156 A1 | 8/2015 |
| WO | WO 2015/119941 A2 | 8/2015 |
| WO | WO 2015/121454 A1 | 8/2015 |
| WO | WO 2015/122967 A1 | 8/2015 |
| WO | WO 2015/123339 A1 | 8/2015 |
| WO | WO 2015/124715 A1 | 8/2015 |
| WO | WO 2015/124718 A1 | 8/2015 |
| WO | WO 2015/126927 A2 | 8/2015 |
| WO | WO 2015/127428 A1 | 8/2015 |
| WO | WO 2015/127439 A1 | 8/2015 |
| WO | WO 2015/129686 A1 | 9/2015 |
| WO | WO 2015/131101 A1 | 9/2015 |
| WO | WO 2015/133554 A1 | 9/2015 |
| WO | WO 2015/134812 A1 | 9/2015 |
| WO | WO 2015/136001 A1 | 9/2015 |
| WO | WO 2015/138510 A1 | 9/2015 |
| WO | WO 2015/138739 A2 | 9/2015 |
| WO | WO 2015/138855 A1 | 9/2015 |
| WO | WO 2015/138870 A2 | 9/2015 |
| WO | WO 2015/139008 A1 | 9/2015 |
| WO | WO 2015/139139 A1 | 9/2015 |
| WO | WO 2015/143046 A2 | 9/2015 |
| WO | WO 2015/143177 A1 | 9/2015 |
| WO | WO 2015/145417 A1 | 10/2015 |
| WO | WO 2015/148431 A1 | 10/2015 |
| WO | WO 2015/148670 A1 | 10/2015 |
| WO | WO 2015/148680 A1 | 10/2015 |
| WO | WO 2015/148761 A1 | 10/2015 |
| WO | WO 2015/148860 A1 | 10/2015 |
| WO | WO 2015/148863 A2 | 10/2015 |
| WO | WO 2015/153760 A2 | 10/2015 |
| WO | WO 2015/153780 A1 | 10/2015 |
| WO | WO 2015/153789 A1 | 10/2015 |
| WO | WO 2015/153791 A1 | 10/2015 |
| WO | WO 2015/153889 A2 | 10/2015 |
| WO | WO 2015/153940 A1 | 10/2015 |
| WO | WO 2015/155341 A1 | 10/2015 |
| WO | WO 2015/155686 A2 | 10/2015 |
| WO | WO 2015/157070 A2 | 10/2015 |
| WO | WO 2015/157534 A1 | 10/2015 |
| WO | WO 2015/159068 A1 | 10/2015 |
| WO | WO 2015/159086 A1 | 10/2015 |
| WO | WO 2015/159087 A1 | 10/2015 |
| WO | WO 2015/160683 A1 | 10/2015 |
| WO | WO 2015/161276 A2 | 10/2015 |
| WO | WO 2015/163733 A1 | 10/2015 |
| WO | WO 2015/164740 A1 | 10/2015 |
| WO | WO 2015/164748 A1 | 10/2015 |
| WO | WO 2015/165274 A1 | 11/2015 |
| WO | WO 2015/165275 A1 | 11/2015 |
| WO | WO 2015/165276 A1 | 11/2015 |
| WO | WO 2015/166272 A2 | 11/2015 |
| WO | WO 2015/167766 A1 | 11/2015 |
| WO | WO 2015/167956 A1 | 11/2015 |
| WO | WO 2015/168125 A1 | 11/2015 |
| WO | WO 2015/168158 A1 | 11/2015 |
| WO | WO 2015/168404 A1 | 11/2015 |
| WO | WO 2015/168547 A2 | 11/2015 |
| WO | WO 2015/168800 A1 | 11/2015 |
| WO | WO 2015/171603 A1 | 11/2015 |
| WO | WO 2015/171894 A1 | 11/2015 |
| WO | WO 2015/171932 A1 | 11/2015 |
| WO | WO 2015/172128 A1 | 11/2015 |
| WO | WO 2015/173436 A1 | 11/2015 |
| WO | WO 2015/175642 A2 | 11/2015 |
| WO | WO 2015/179540 A1 | 11/2015 |
| WO | WO 2015/183025 A1 | 12/2015 |
| WO | WO 2015/183026 A1 | 12/2015 |
| WO | WO 2015/183885 A1 | 12/2015 |
| WO | WO 2015/184259 A1 | 12/2015 |
| WO | WO 2015/184262 A1 | 12/2015 |
| WO | WO 2015/184268 A1 | 12/2015 |
| WO | WO 2015/188056 A1 | 12/2015 |
| WO | WO 2015/188065 A1 | 12/2015 |
| WO | WO 2015/188094 A1 | 12/2015 |
| WO | WO 2015/188109 A1 | 12/2015 |
| WO | WO 2015/188132 A1 | 12/2015 |
| WO | WO 2015/188135 A1 | 12/2015 |
| WO | WO 2015/188191 A1 | 12/2015 |
| WO | WO 2015/189693 A1 | 12/2015 |
| WO | WO 2015/191693 A2 | 12/2015 |
| WO | WO 2015/191899 A1 | 12/2015 |
| WO | WO 2015/191911 A2 | 12/2015 |
| WO | WO 2015/193858 A1 | 12/2015 |
| WO | WO 2015/195547 A1 | 12/2015 |
| WO | WO 2015/195621 A1 | 12/2015 |
| WO | WO 2015/195798 A1 | 12/2015 |
| WO | WO 2015/198020 A1 | 12/2015 |
| WO | WO 2015/200334 A1 | 12/2015 |
| WO | WO 2015/200378 A2 | 12/2015 |
| WO | WO 2015/200555 A2 | 12/2015 |
| WO | WO 2015/200805 A2 | 12/2015 |
| WO | WO 2016/001978 A1 | 1/2016 |
| WO | WO 2016/004010 A1 | 1/2016 |
| WO | WO 2016/007347 A1 | 1/2016 |
| WO | WO 2016/007604 A1 | 1/2016 |
| WO | WO 2016/007948 A1 | 1/2016 |
| WO | WO 2016/011080 A2 | 1/2016 |
| WO | WO 2016/011210 A2 | 1/2016 |
| WO | WO 2016/011428 A1 | 1/2016 |
| WO | WO 2016/012544 A2 | 1/2016 |
| WO | WO 2016/012552 A1 | 1/2016 |
| WO | WO 2016/014409 A1 | 1/2016 |
| WO | WO 2016/014565 A1 | 1/2016 |
| WO | WO 2016/014794 A1 | 1/2016 |
| WO | WO 2016/014837 A1 | 1/2016 |
| WO | WO 2016/016119 A1 | 2/2016 |
| WO | WO 2016/016358 A1 | 2/2016 |
| WO | WO 2016/019144 A2 | 2/2016 |
| WO | WO 2016/020399 A1 | 2/2016 |
| WO | WO 2016/021972 A1 | 2/2016 |
| WO | WO 2016/021973 A1 | 2/2016 |
| WO | WO 2016/022363 A2 | 2/2016 |
| WO | WO 2016/022866 A1 | 2/2016 |
| WO | WO 2016/022931 A1 | 2/2016 |
| WO | WO 2016/025131 A1 | 2/2016 |
| WO | WO 2016/025469 A1 | 2/2016 |
| WO | WO 2016/025759 A1 | 2/2016 |
| WO | WO 2016/026444 A1 | 2/2016 |
| WO | WO 2016/028682 A1 | 2/2016 |
| WO | WO 2016/028843 A2 | 2/2016 |
| WO | WO 2016/028887 A1 | 2/2016 |
| WO | WO 2016/033088 A1 | 3/2016 |
| WO | WO 2016/033230 A1 | 3/2016 |
| WO | WO 2016/033246 A1 | 3/2016 |
| WO | WO 2016/033298 A1 | 3/2016 |
| WO | WO 2016/035044 A1 | 3/2016 |
| WO | WO 2016/036754 A1 | 3/2016 |
| WO | WO 2016/037157 A2 | 3/2016 |
| WO | WO 2016/040030 A1 | 3/2016 |
| WO | WO 2016/040594 A1 | 3/2016 |
| WO | WO 2016/044182 A1 | 3/2016 |
| WO | WO 2016/044416 A1 | 3/2016 |
| WO | WO 2016/046635 A1 | 3/2016 |
| WO | WO 2016/049024 A2 | 3/2016 |

(56) References Cited

FOREIGN PATENT DOCUMENTS

| | | |
|---|---|---|
| WO | WO 2016/049163 A2 | 3/2016 |
| WO | WO 2016/049230 A1 | 3/2016 |
| WO | WO 2016/049251 A1 | 3/2016 |
| WO | WO 2016/049258 A2 | 3/2016 |
| WO | WO 2016/053397 A2 | 4/2016 |
| WO | WO 2016/054326 A1 | 4/2016 |
| WO | WO 2016/057061 A2 | 4/2016 |
| WO | WO 2016/057821 A2 | 4/2016 |
| WO | WO 2016/057835 A2 | 4/2016 |
| WO | WO 2016/057850 A1 | 4/2016 |
| WO | WO 2016/057951 A2 | 4/2016 |
| WO | WO 2016/057961 A1 | 4/2016 |
| WO | WO 2016/061073 A1 | 4/2016 |
| WO | WO 2016/061374 A1 | 4/2016 |
| WO | WO 2016/061481 A1 | 4/2016 |
| WO | WO 2016/061523 A1 | 4/2016 |
| WO | WO 2016/064894 A2 | 4/2016 |
| WO | WO 2016/069282 A1 | 5/2016 |
| WO | WO 2016/069283 A1 | 5/2016 |
| WO | WO 2016/069591 A2 | 5/2016 |
| WO | WO 2016/069910 A1 | 5/2016 |
| WO | WO 2016/069912 A1 | 5/2016 |
| WO | WO 2016/070037 A2 | 5/2016 |
| WO | WO 2016/070070 A1 | 5/2016 |
| WO | WO 2016/070129 A1 | 5/2016 |
| WO | WO 2016/072399 A1 | 5/2016 |
| WO | WO 2016/072936 A1 | 5/2016 |
| WO | WO 2016/073433 A1 | 5/2016 |
| WO | WO 2016/073559 A1 | 5/2016 |
| WO | WO 2016/073990 A2 | 5/2016 |
| WO | WO 2016/075662 A2 | 5/2016 |
| WO | WO 2016/076672 A1 | 5/2016 |
| WO | WO 2016/077273 A1 | 5/2016 |
| WO | WO 2016/077350 A1 | 5/2016 |
| WO | WO 2016/080097 A1 | 5/2016 |
| WO | WO 2016/080795 A1 | 5/2016 |
| WO | WO 2016/081923 A2 | 5/2016 |
| WO | WO 2016/081924 A1 | 5/2016 |
| WO | WO 2016/082135 A1 | 6/2016 |
| WO | WO 2016/083811 A1 | 6/2016 |
| WO | WO 2016/084084 A1 | 6/2016 |
| WO | WO 2016/084088 A1 | 6/2016 |
| WO | WO 2016/086177 A2 | 6/2016 |
| WO | WO 2016/089433 A1 | 6/2016 |
| WO | WO 2016/089866 A1 | 6/2016 |
| WO | WO 2016/089883 A1 | 6/2016 |
| WO | WO 2016/090385 A1 | 6/2016 |
| WO | WO 2016/094679 A1 | 6/2016 |
| WO | WO 2016/094845 A2 | 6/2016 |
| WO | WO 2016/094867 A1 | 6/2016 |
| WO | WO 2016/094872 A1 | 6/2016 |
| WO | WO 2016/094874 A1 | 6/2016 |
| WO | WO 2016/094880 A1 | 6/2016 |
| WO | WO 2016/094888 A1 | 6/2016 |
| WO | WO 2016/097212 A1 | 6/2016 |
| WO | WO 2016/097231 A2 | 6/2016 |
| WO | WO 2016/097751 A1 | 6/2016 |
| WO | WO 2016/099887 A1 | 6/2016 |
| WO | WO 2016/100272 A1 | 6/2016 |
| WO | WO 2016/100389 A1 | 6/2016 |
| WO | WO 2016/100568 A1 | 6/2016 |
| WO | WO 2016/100571 A1 | 6/2016 |
| WO | WO 2016/100951 A2 | 6/2016 |
| WO | WO 2016/100955 A2 | 6/2016 |
| WO | WO 2016/100974 A1 | 6/2016 |
| WO | WO 2016/103233 A2 | 6/2016 |
| WO | WO 2016/104716 A1 | 6/2016 |
| WO | WO 2016/106236 A1 | 6/2016 |
| WO | WO 2016/106239 A1 | 6/2016 |
| WO | WO 2016/106244 A1 | 6/2016 |
| WO | WO 2016/106338 A2 | 6/2016 |
| WO | WO 2016/108926 A1 | 7/2016 |
| WO | WO 2016/109255 A1 | 7/2016 |
| WO | WO 2016/109840 A2 | 7/2016 |
| WO | WO 2016/110214 A1 | 7/2016 |
| WO | WO 2016/110453 A1 | 7/2016 |
| WO | WO 2016/110511 A1 | 7/2016 |
| WO | WO 2016/110512 A1 | 7/2016 |
| WO | WO 2016/111546 A2 | 7/2016 |
| WO | WO 2016/112242 A1 | 7/2016 |
| WO | WO 2016/112351 A1 | 7/2016 |
| WO | WO 2016/112963 A1 | 7/2016 |
| WO | WO 2016/114972 A1 | 7/2016 |
| WO | WO 2016/115179 A1 | 7/2016 |
| WO | WO 2016/115326 A1 | 7/2016 |
| WO | WO 2016/115355 A1 | 7/2016 |
| WO | WO 2016/116032 A1 | 7/2016 |
| WO | WO 2016/120480 A1 | 8/2016 |
| WO | WO 2016/123071 A1 | 8/2016 |
| WO | WO 2016/123230 A1 | 8/2016 |
| WO | WO 2016/123243 A1 | 8/2016 |
| WO | WO 2016/123578 A1 | 8/2016 |
| WO | WO 2016/126747 A1 | 8/2016 |
| WO | WO 2016/130600 A2 | 8/2016 |
| WO | WO 2016/130697 A1 | 8/2016 |
| WO | WO 2016/131009 A1 | 8/2016 |
| WO | WO 2016/132122 A1 | 8/2016 |
| WO | WO 2016/133165 A1 | 8/2016 |
| WO | WO 2016/135507 A1 | 9/2016 |
| WO | WO 2016/135557 A2 | 9/2016 |
| WO | WO 2016/135558 A2 | 9/2016 |
| WO | WO 2016/135559 A2 | 9/2016 |
| WO | WO 2016/137774 A1 | 9/2016 |
| WO | WO 2016/137949 A1 | 9/2016 |
| WO | WO 2016/141224 A1 | 9/2016 |
| WO | WO 2016/141893 A1 | 9/2016 |
| WO | WO 2016/142719 A1 | 9/2016 |
| WO | WO 2016/145150 A2 | 9/2016 |
| WO | WO 2016/148994 A1 | 9/2016 |
| WO | WO 2016/149484 A2 | 9/2016 |
| WO | WO 2016/149547 A1 | 9/2016 |
| WO | WO 2016/150336 A1 | 9/2016 |
| WO | WO 2016/150855 A1 | 9/2016 |
| WO | WO 2016/154016 A2 | 9/2016 |
| WO | WO 2016/154579 A2 | 9/2016 |
| WO | WO 2016/154596 A1 | 9/2016 |
| WO | WO 2016/155482 A1 | 10/2016 |
| WO | WO 2016/161004 A1 | 10/2016 |
| WO | WO 2016/161207 A1 | 10/2016 |
| WO | WO 2016/161260 A1 | 10/2016 |
| WO | WO 2016/161380 A1 | 10/2016 |
| WO | WO 2016/161446 A1 | 10/2016 |
| WO | WO 2016/164356 A1 | 10/2016 |
| WO | WO 2016/164797 A1 | 10/2016 |
| WO | WO 2016/166340 A1 | 10/2016 |
| WO | WO 2016/167300 A1 | 10/2016 |
| WO | WO 2016/170484 A1 | 10/2016 |
| WO | WO 2016/172359 A2 | 10/2016 |
| WO | WO 2016/172727 A1 | 10/2016 |
| WO | WO 2016/174056 A1 | 11/2016 |
| WO | WO 2016/174151 A1 | 11/2016 |
| WO | WO 2016/174250 A1 | 11/2016 |
| WO | WO 2016/176191 A1 | 11/2016 |
| WO | WO 2016/176404 A1 | 11/2016 |
| WO | WO 2016/176690 A2 | 11/2016 |
| WO | WO 2016/177682 A1 | 11/2016 |
| WO | WO 2016/178207 A1 | 11/2016 |
| WO | WO 2016/179038 A1 | 11/2016 |
| WO | WO 2016/179112 A1 | 11/2016 |
| WO | WO 2016/181357 A1 | 11/2016 |
| WO | WO 2016/182893 A1 | 11/2016 |
| WO | WO 2016/182917 A1 | 11/2016 |
| WO | WO 2016/182959 A1 | 11/2016 |
| WO | WO 2016/183236 A1 | 11/2016 |
| WO | WO 2016/183298 A2 | 11/2016 |
| WO | WO 2016/183345 A1 | 11/2016 |
| WO | WO 2016/183402 A1 | 11/2016 |
| WO | WO 2016/183438 A1 | 11/2016 |
| WO | WO 2016/183448 A1 | 11/2016 |
| WO | WO 2016/184955 A2 | 11/2016 |
| WO | WO 2016/184989 A1 | 11/2016 |
| WO | WO 2016/185411 A1 | 11/2016 |
| WO | WO 2016/186745 A1 | 11/2016 |
| WO | WO 2016/186772 A2 | 11/2016 |

(56) References Cited

FOREIGN PATENT DOCUMENTS

| | | |
|---|---|---|
| WO | WO 2016/186946 A1 | 11/2016 |
| WO | WO 2016/186953 A1 | 11/2016 |
| WO | WO 2016/187717 A1 | 12/2016 |
| WO | WO 2016/187904 A1 | 12/2016 |
| WO | WO 2016/191684 A1 | 12/2016 |
| WO | WO 2016/191869 A1 | 12/2016 |
| WO | WO 2016/196273 A1 | 12/2016 |
| WO | WO 2016/196282 A1 | 12/2016 |
| WO | WO 2016/196308 A1 | 12/2016 |
| WO | WO 2016/196361 A1 | 12/2016 |
| WO | WO 2016/196499 A1 | 12/2016 |
| WO | WO 2016/196539 A2 | 12/2016 |
| WO | WO 2016/196655 A1 | 12/2016 |
| WO | WO 2016/196805 A1 | 12/2016 |
| WO | WO 2016/196887 A1 | 12/2016 |
| WO | WO 2016/197132 A1 | 12/2016 |
| WO | WO 2016/197133 A1 | 12/2016 |
| WO | WO 2016/197354 A1 | 12/2016 |
| WO | WO 2016/197355 A1 | 12/2016 |
| WO | WO 2016/197356 A1 | 12/2016 |
| WO | WO 2016/197357 A1 | 12/2016 |
| WO | WO 2016/197358 A1 | 12/2016 |
| WO | WO 2016/197359 A1 | 12/2016 |
| WO | WO 2016/197360 A1 | 12/2016 |
| WO | WO 2016/197361 A1 | 12/2016 |
| WO | WO 2016/197362 A1 | 12/2016 |
| WO | WO 2016/198361 A1 | 12/2016 |
| WO | WO 2016/198500 A1 | 12/2016 |
| WO | WO 2016/200263 A1 | 12/2016 |
| WO | WO 2016/201047 A1 | 12/2016 |
| WO | WO 2016/201138 A1 | 12/2016 |
| WO | WO 2016/201152 A1 | 12/2016 |
| WO | WO 2016/201153 A1 | 12/2016 |
| WO | WO 2016/201155 A1 | 12/2016 |
| WO | WO 2016/205276 A1 | 12/2016 |
| WO | WO 2016/205613 A1 | 12/2016 |
| WO | WO 2016/205623 A1 | 12/2016 |
| WO | WO 2016/205680 A1 | 12/2016 |
| WO | WO 2016/205688 A2 | 12/2016 |
| WO | WO 2016/205703 A1 | 12/2016 |
| WO | WO 2016/205711 A1 | 12/2016 |
| WO | WO 2016/205728 A1 | 12/2016 |
| WO | WO 2016/205745 A2 | 12/2016 |
| WO | WO 2016/205749 A1 | 12/2016 |
| WO | WO 2016/205759 A1 | 12/2016 |
| WO | WO 2016/205764 A1 | 12/2016 |
| WO | WO 2017/001572 A1 | 1/2017 |
| WO | WO 2017/001988 A1 | 1/2017 |
| WO | WO 2017/004261 A1 | 1/2017 |
| WO | WO 2017/004279 A2 | 1/2017 |
| WO | WO 2017/004616 A1 | 1/2017 |
| WO | WO 2017/005807 A1 | 1/2017 |
| WO | WO 2017/009399 A1 | 1/2017 |
| WO | WO 2017/010556 A1 | 1/2017 |
| WO | WO 2017/011519 A1 | 1/2017 |
| WO | WO 2017/011721 A1 | 1/2017 |
| WO | WO 2017/011804 A1 | 1/2017 |
| WO | WO 2017/015015 A1 | 1/2017 |
| WO | WO 2017/015101 A1 | 1/2017 |
| WO | WO 2017/015567 A1 | 1/2017 |
| WO | WO 2017/015637 A1 | 1/2017 |
| WO | WO 2017/017016 A1 | 2/2017 |
| WO | WO 2017/019867 A1 | 2/2017 |
| WO | WO 2017/019895 A1 | 2/2017 |
| WO | WO 2017/023803 A1 | 2/2017 |
| WO | WO 2017/023974 A1 | 2/2017 |
| WO | WO 2017/024047 A1 | 2/2017 |
| WO | WO 2017/024319 A1 | 2/2017 |
| WO | WO 2017/024343 A1 | 2/2017 |
| WO | WO 2017/024602 A1 | 2/2017 |
| WO | WO 2017/025323 A1 | 2/2017 |
| WO | WO 2017/027423 A1 | 2/2017 |
| WO | WO 2017/028768 A1 | 2/2017 |
| WO | WO 2017/029664 A1 | 2/2017 |
| WO | WO 2017/031360 A1 | 2/2017 |
| WO | WO 2017/031483 A1 | 2/2017 |
| WO | WO 2017/035416 A2 | 3/2017 |
| WO | WO 2017/040348 A1 | 3/2017 |
| WO | WO 2017/040511 A1 | 3/2017 |
| WO | WO 2017/040709 A1 | 3/2017 |
| WO | WO 2017/040786 A1 | 3/2017 |
| WO | WO 2017/040793 A1 | 3/2017 |
| WO | WO 2017/040813 A2 | 3/2017 |
| WO | WO 2017/043573 A1 | 3/2017 |
| WO | WO 2017/043656 A1 | 3/2017 |
| WO | WO 2017/044419 A1 | 3/2017 |
| WO | WO 2017/044776 A1 | 3/2017 |
| WO | WO 2017/044857 A2 | 3/2017 |
| WO | WO 2017/049129 A2 | 3/2017 |
| WO | WO 2017/050963 A1 | 3/2017 |
| WO | WO 2017/053312 A1 | 3/2017 |
| WO | WO 2017/053431 A2 | 3/2017 |
| WO | WO 2017/053713 A1 | 3/2017 |
| WO | WO 2017/053729 A1 | 3/2017 |
| WO | WO 2017/053753 A1 | 3/2017 |
| WO | WO 2017/053762 A1 | 3/2017 |
| WO | WO 2017/053879 A1 | 3/2017 |
| WO | WO 2017/054721 A1 | 4/2017 |
| WO | WO 2017/058658 A2 | 4/2017 |
| WO | WO 2017/059241 A1 | 4/2017 |
| WO | WO 2017/062605 A1 | 4/2017 |
| WO | WO 2017/062723 A1 | 4/2017 |
| WO | WO 2017/062754 A1 | 4/2017 |
| WO | WO 2017/062855 A1 | 4/2017 |
| WO | WO 2017/062886 A1 | 4/2017 |
| WO | WO 2017/062983 A1 | 4/2017 |
| WO | WO 2017/064439 A1 | 4/2017 |
| WO | WO 2017/064546 A1 | 4/2017 |
| WO | WO 2017/064566 A2 | 4/2017 |
| WO | WO 2017/066175 A1 | 4/2017 |
| WO | WO 2017/066497 A2 | 4/2017 |
| WO | WO 2017/066588 A2 | 4/2017 |
| WO | WO 2017/066707 A1 | 4/2017 |
| WO | WO 2017/068077 A1 | 4/2017 |
| WO | WO 2017/068377 A1 | 4/2017 |
| WO | WO 2017/069829 A2 | 4/2017 |
| WO | WO 2017/070029 A1 | 4/2017 |
| WO | WO 2017/070032 A1 | 4/2017 |
| WO | WO 2017/070169 A1 | 4/2017 |
| WO | WO 2017/070284 A1 | 4/2017 |
| WO | WO 2017/070598 A1 | 4/2017 |
| WO | WO 2017/070605 A1 | 4/2017 |
| WO | WO 2017/070632 A2 | 4/2017 |
| WO | WO 2017/070633 A2 | 4/2017 |
| WO | WO 2017/072590 A1 | 5/2017 |
| WO | WO 2017/074526 A1 | 5/2017 |
| WO | WO 2017/074962 A1 | 5/2017 |
| WO | WO 2017/075261 A1 | 5/2017 |
| WO | WO 2017/075335 A1 | 5/2017 |
| WO | WO 2017/075475 A1 | 5/2017 |
| WO | WO 2017/077135 A1 | 5/2017 |
| WO | WO 2017/077329 A2 | 5/2017 |
| WO | WO 2017/078751 A1 | 5/2017 |
| WO | WO 2017/079400 A1 | 5/2017 |
| WO | WO 2017/079428 A1 | 5/2017 |
| WO | WO 2017/079673 A1 | 5/2017 |
| WO | WO 2017/079724 A1 | 5/2017 |
| WO | WO 2017/081097 A1 | 5/2017 |
| WO | WO 2017/081288 A1 | 5/2017 |
| WO | WO 2017/083368 A1 | 5/2017 |
| WO | WO 2017/083722 A1 | 5/2017 |
| WO | WO 2017/083766 A1 | 5/2017 |
| WO | WO 2017/087395 A1 | 5/2017 |
| WO | WO 2017/090724 A1 | 6/2017 |
| WO | WO 2017/091510 A1 | 6/2017 |
| WO | WO 2017/091630 A1 | 6/2017 |
| WO | WO 2017/092201 A1 | 6/2017 |
| WO | WO 2017/093370 A1 | 6/2017 |
| WO | WO 2017/095111 A1 | 6/2017 |
| WO | WO 2017/096041 A1 | 6/2017 |
| WO | WO 2017/096237 A1 | 6/2017 |
| WO | WO 2017/100158 A1 | 6/2017 |
| WO | WO 2017/100431 A2 | 6/2017 |
| WO | WO 2017/104404 A1 | 6/2017 |

(56) References Cited

FOREIGN PATENT DOCUMENTS

| | | |
|---|---|---|
| WO | WO 2017/105251 A1 | 6/2017 |
| WO | WO 2017/105350 A1 | 6/2017 |
| WO | WO 2017/105991 A1 | 6/2017 |
| WO | WO 2017/106414 A1 | 6/2017 |
| WO | WO 2017/106528 A2 | 6/2017 |
| WO | WO 2017/106537 A2 | 6/2017 |
| WO | WO 2017/106569 A1 | 6/2017 |
| WO | WO 2017/106616 A1 | 6/2017 |
| WO | WO 2017/106657 A1 | 6/2017 |
| WO | WO 2017/106767 A1 | 6/2017 |
| WO | WO 2017/109134 A1 | 6/2017 |
| WO | WO 2017/109757 A1 | 6/2017 |
| WO | WO 2017/112620 A1 | 6/2017 |
| WO | WO 2017/115268 A1 | 7/2017 |
| WO | WO 2017/117395 A1 | 7/2017 |
| WO | WO 2017/118598 A1 | 7/2017 |
| WO | WO 2017/118720 A1 | 7/2017 |
| WO | WO 2017/123609 A1 | 7/2017 |
| WO | WO 2017/123910 A1 | 7/2017 |
| WO | WO 2017/124086 A1 | 7/2017 |
| WO | WO 2017/124100 A1 | 7/2017 |
| WO | WO 2017/124652 A1 | 7/2017 |
| WO | WO 2017/126987 A1 | 7/2017 |
| WO | WO 2017/127807 A1 | 7/2017 |
| WO | WO 2017/131237 A1 | 8/2017 |
| WO | WO 2017/132112 A1 | 8/2017 |
| WO | WO 2017/132580 A2 | 8/2017 |
| WO | WO 2017/136520 A1 | 8/2017 |
| WO | WO 2017/136629 A1 | 8/2017 |
| WO | WO 2017/136794 A1 | 8/2017 |
| WO | WO 2017/139264 A1 | 8/2017 |
| WO | WO 2017/139505 A2 | 8/2017 |
| WO | WO 2017/141173 A2 | 8/2017 |
| WO | WO 2017/142835 A1 | 8/2017 |
| WO | WO 2017/142999 A2 | 8/2017 |
| WO | WO 2017/143042 A2 | 8/2017 |
| WO | WO 2017/147278 A1 | 8/2017 |
| WO | WO 2017/147432 A1 | 8/2017 |
| WO | WO 2017/147446 A1 | 8/2017 |
| WO | WO 2017/147555 A1 | 8/2017 |
| WO | WO 2017/151444 A1 | 9/2017 |
| WO | WO 2017/152015 A1 | 9/2017 |
| WO | WO 2017/155717 A1 | 9/2017 |
| WO | WO 2017/157422 A1 | 9/2017 |
| WO | WO 2017/158153 A1 | 9/2017 |
| WO | WO 2017/160689 A1 | 9/2017 |
| WO | WO 2017/160752 A1 | 9/2017 |
| WO | WO 2017/160890 A1 | 9/2017 |
| WO | WO 2017/161068 A1 | 9/2017 |
| WO | WO 2017/165826 A1 | 9/2017 |
| WO | WO 2017/165862 A1 | 9/2017 |
| WO | WO 2017/172644 A2 | 10/2017 |
| WO | WO 2017/172645 A2 | 10/2017 |
| WO | WO 2017/172860 A1 | 10/2017 |
| WO | WO 2017/173004 A1 | 10/2017 |
| WO | WO 2017/173054 A1 | 10/2017 |
| WO | WO 2017/173092 A1 | 10/2017 |
| WO | WO 2017/174329 A1 | 10/2017 |
| WO | WO 2017/176529 A1 | 10/2017 |
| WO | WO 2017/176806 A1 | 10/2017 |
| WO | WO 2017/178590 A1 | 10/2017 |
| WO | WO 2017/180694 A1 | 10/2017 |
| WO | WO 2017/180711 A1 | 10/2017 |
| WO | WO 2017/180915 A2 | 10/2017 |
| WO | WO 2017/180926 A1 | 10/2017 |
| WO | WO 2017/181107 A2 | 10/2017 |
| WO | WO 2017/181735 A2 | 10/2017 |
| WO | WO 2017/182468 A1 | 10/2017 |
| WO | WO 2017/184334 A1 | 10/2017 |
| WO | WO 2017/184768 A1 | 10/2017 |
| WO | WO 2017/184786 A1 | 10/2017 |
| WO | WO 2017/186550 A1 | 11/2017 |
| WO | WO 2017/189308 A1 | 11/2017 |
| WO | WO 2017/189336 A1 | 11/2017 |
| WO | WO 2017/190257 A1 | 11/2017 |
| WO | WO 2017/190664 A1 | 11/2017 |
| WO | WO 2017/191210 A1 | 11/2017 |
| WO | WO 2017/192172 A1 | 11/2017 |
| WO | WO 2017/192512 A2 | 11/2017 |
| WO | WO 2017/192544 A1 | 11/2017 |
| WO | WO 2017/192573 A1 | 11/2017 |
| WO | WO 2017/193029 A2 | 11/2017 |
| WO | WO 2017/193053 A1 | 11/2017 |
| WO | WO 2017/196768 A1 | 11/2017 |
| WO | WO 2017/197038 A1 | 11/2017 |
| WO | WO 2017/197238 A1 | 11/2017 |
| WO | WO 2017/197301 A1 | 11/2017 |
| WO | WO 2017/201476 A1 | 11/2017 |
| WO | WO 2017/205290 A1 | 11/2017 |
| WO | WO 2017/205423 A1 | 11/2017 |
| WO | WO 2017/207589 A1 | 12/2017 |
| WO | WO 2017/208247 A1 | 12/2017 |
| WO | WO 2017/209809 A1 | 12/2017 |
| WO | WO 2017/213896 A1 | 12/2017 |
| WO | WO 2017/213898 A2 | 12/2017 |
| WO | WO 2017/214460 A1 | 12/2017 |
| WO | WO 2017/216392 A1 | 12/2017 |
| WO | WO 2017/216771 A2 | 12/2017 |
| WO | WO 2017/218185 A1 | 12/2017 |
| WO | WO 2017/219027 A1 | 12/2017 |
| WO | WO 2017/219033 A1 | 12/2017 |
| WO | WO 2017/220751 A1 | 12/2017 |
| WO | WO 2017/222370 A1 | 12/2017 |
| WO | WO 2017/222773 A1 | 12/2017 |
| WO | WO 2017/222834 A1 | 12/2017 |
| WO | WO 2017/223107 A1 | 12/2017 |
| WO | WO 2017/223330 A1 | 12/2017 |
| WO | WO 2018/000657 A1 | 1/2018 |
| WO | WO 2018/002719 A1 | 1/2018 |
| WO | WO 2018/005117 A1 | 1/2018 |
| WO | WO 2018/005289 A2 | 1/2018 |
| WO | WO 2018/005691 A1 | 1/2018 |
| WO | WO 2018/005782 A1 | 1/2018 |
| WO | WO 2018/005873 A1 | 1/2018 |
| WO | WO 2018/06693 A1 | 1/2018 |
| WO | WO 2018/009520 A1 | 1/2018 |
| WO | WO 2018/009562 A1 | 1/2018 |
| WO | WO 2018/009822 A1 | 1/2018 |
| WO | WO 2018/013821 A1 | 1/2018 |
| WO | WO 2018/013990 A1 | 1/2018 |
| WO | WO 2018/014384 A1 | 1/2018 |
| WO | WO 2018/015444 A1 | 1/2018 |
| WO | WO 2018/015936 A2 | 1/2018 |
| WO | WO 2018/017754 A1 | 1/2018 |
| WO | WO 2018/018979 A1 | 2/2018 |
| WO | WO 2018/020248 A1 | 2/2018 |
| WO | WO 2018/022480 A1 | 2/2018 |
| WO | WO 2018/022634 A1 | 2/2018 |
| WO | WO 2018/025206 A1 | 2/2018 |
| WO | WO 2018/026723 A1 | 2/2018 |
| WO | WO 2018/026976 A1 | 2/2018 |
| WO | WO 2018/027078 A1 | 2/2018 |
| WO | WO 2018/030608 A1 | 2/2018 |
| WO | WO 2018/031683 A1 | 2/2018 |
| WO | WO 2018/035250 A1 | 2/2018 |
| WO | WO 2018/035300 A1 | 2/2018 |
| WO | WO 2018/035423 A1 | 2/2018 |
| WO | WO 2018/035503 A1 | 2/2018 |
| WO | WO 2018/039145 A1 | 3/2018 |
| WO | WO 2018/039438 A1 | 3/2018 |
| WO | WO 2018/039440 A1 | 3/2018 |
| WO | WO 2018/039448 A1 | 3/2018 |
| WO | WO 2018/045630 A1 | 3/2018 |
| WO | WO 2018/048827 A1 | 3/2018 |
| WO | WO 2018/049168 A1 | 3/2018 |
| WO | WO 2018/051347 A1 | 3/2018 |
| WO | WO 2018/058064 A1 | 3/2018 |
| WO | WO 2018/062866 A2 | 4/2018 |
| WO | WO 2018/064352 A1 | 4/2018 |
| WO | WO 2018/064371 A1 | 4/2018 |
| WO | WO 2018/064516 A1 | 4/2018 |
| WO | WO 2018/067546 A1 | 4/2018 |
| WO | WO 2018/067846 A1 | 4/2018 |
| WO | WO 2018/068053 A2 | 4/2018 |

(56) References Cited

FOREIGN PATENT DOCUMENTS

| WO | WO 2018/069474 A1 | 4/2018 |
|---|---|---|
| WO | WO 2018/071623 A2 | 4/2018 |
| WO | WO 2018/071663 A1 | 4/2018 |
| WO | WO 2018/071868 A1 | 4/2018 |
| WO | WO 2018/071892 A1 | 4/2018 |
| WO | WO 2018/074979 | 4/2018 |
| WO | WO 2018/079134 A1 | 5/2018 |
| WO | WO 2018/080573 A1 | 5/2018 |
| WO | WO 2018/081504 A1 | 5/2018 |
| WO | WO 2018/081535 A2 | 5/2018 |
| WO | WO 2018/081728 A1 | 5/2018 |
| WO | WO 2018/083128 A2 | 5/2018 |
| WO | WO 2018/083606 A1 | 5/2018 |
| WO | WO 2018/085288 A1 | 5/2018 |
| WO | WO 2018/086623 A1 | 5/2018 |
| WO | WO 2018/093990 A1 | 5/2018 |
| WO | WO 2018/098383 A1 | 5/2018 |
| WO | WO 2018/098480 A1 | 5/2018 |
| WO | WO 2018/098587 A1 | 6/2018 |
| WO | WO 2018/099256 A1 | 6/2018 |
| WO | WO 2018/103686 A1 | 6/2018 |
| WO | WO 2018/106268 A1 | 6/2018 |
| WO | WO 2018/107028 A1 | 6/2018 |
| WO | WO 2018/107103 A1 | 6/2018 |
| WO | WO 2018/107129 A1 | 6/2018 |
| WO | WO 2018-108272 A1 | 6/2018 |
| WO | WO 2018/109101 A1 | 6/2018 |
| WO | WO 2018/111946 A1 | 6/2018 |
| WO | WO 2018/111947 A1 | 6/2018 |
| WO | WO 2018/112336 A1 | 6/2018 |
| WO | WO 2018/112446 A2 | 6/2018 |
| WO | WO 2018/119354 A1 | 6/2018 |
| WO | WO 2018/119359 A1 | 6/2018 |
| WO | WO 2018/130830 A1 | 7/2018 |
| WO | WO 2018/135838 A1 | 7/2018 |
| WO | WO 2018/136396 A2 | 7/2018 |
| WO | WO 2018/138385 A1 | 8/2018 |
| WO | WO 2018/148246 A1 | 8/2018 |
| WO | WO 2018/148256 A1 | 8/2018 |
| WO | WO 2018/148647 A2 | 8/2018 |
| WO | WO 2018/149418 A1 | 8/2018 |
| WO | WO 2018/149888 A1 | 8/2018 |
| WO | WO 2018/152418 A1 | 8/2018 |
| WO | WO 2018/154380 A1 | 8/2018 |
| WO | WO 2018/154387 A1 | 8/2018 |
| WO | WO 2018/154412 A1 | 8/2018 |
| WO | WO 2018/154413 A1 | 8/2018 |
| WO | WO 2018/154418 A1 | 8/2018 |
| WO | WO 2018/154439 A1 | 8/2018 |
| WO | WO 2018/154459 A1 | 8/2018 |
| WO | WO 2018/154462 A1 | 8/2018 |
| WO | WO 2018/156372 A1 | 8/2018 |
| WO | WO 2018/161009 A1 | 9/2018 |
| WO | WO 2018/165504 A1 | 9/2018 |
| WO | WO 2018/165629 A1 | 9/2018 |
| WO | WO 2018/170015 A1 | 9/2018 |
| WO | WO 2018/170340 A1 | 9/2018 |
| WO | WO 2018/175502 A2 | 9/2018 |
| WO | WO 2018/177351 A1 | 10/2018 |
| WO | WO 2018/179578 A1 | 10/2018 |
| WO | WO 2018/183403 A1 | 10/2018 |
| WO | WO 2018/195545 A2 | 10/2018 |
| WO | WO 2018/195555 A1 | 10/2018 |
| WO | WO 2018/197020 A1 | 11/2018 |
| WO | WO 2018/197495 A1 | 11/2018 |
| WO | WO 2018/202800 A1 | 11/2018 |
| WO | WO 2018/204493 A1 | 11/2018 |
| WO | WO 2018/208755 A1 | 11/2018 |
| WO | WO 2018/208998 A1 | 11/2018 |
| WO | WO 2018/209158 A2 | 11/2018 |
| WO | WO 2018/209320 A1 | 11/2018 |
| WO | WO 2018/213708 A1 | 11/2018 |
| WO | WO 2018/213726 A1 | 11/2018 |
| WO | WO 2018/213771 A1 | 11/2018 |
| WO | WO 2018/213791 A1 | 11/2018 |
| WO | WO 2018/217852 A1 | 11/2018 |
| WO | WO 2018/217981 A1 | 11/2018 |
| WO | WO 2018/218166 A1 | 11/2018 |
| WO | WO 2018/218188 A2 | 11/2018 |
| WO | WO 2018/218206 A1 | 11/2018 |
| WO | WO 2019/005886 A1 | 1/2019 |
| WO | WO 2019/079347 | 4/2019 |
| WO | WO 2019/118949 A1 | 6/2019 |
| WO | WO 2019/139645 A2 | 7/2019 |
| WO | WO 2019/226953 A1 | 11/2019 |
| WO | WO 2020/014261 A1 | 1/2020 |
| WO | WO 2020/041751 A1 | 2/2020 |

OTHER PUBLICATIONS

U.S. Appl. No. 62/288,661, Muir et al., filed Jan. 29, 2016.
U.S. Appl. No. 62/357,332, Liu et al., filed Jun. 30, 2016.
[No Author Listed] Score result for SEQ 355 to WO2017032580. Muir et al. 2016.
Aihara et al., A conformational switch controls the DNA cleavage activity of lambda integrase. Mol Cell. Jul. 2003;12(1):187-98.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Batey et al., Structure of a natural guanine-responsive riboswitch complexed with the metabolite hypoxanthine. Nature. Nov. 18, 2004;432(7015):411-5.
Bershtein et al., Advances in laboratory evolution of enzymes. Curr Opin; Chem Biol. Apr. 2008;12(2):151-8. doi: 10.1016/j.cbpa.2008.01.027. Epub Mar. 7, 2008. Review.
Bogdanove et al., TAL effectors: customizable proteins for DNA targeting. Science. Sep. 30, 2011;333(6051):1843-6. doi: 10.1126/science.1204094.
Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi: 10.1111/1574-6968.12371. Epub Jan. 27, 2014.
Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.
Buskirk et al., Directed evolution of ligand dependence: small-molecule-activated protein splicing. Proc Natl Acad Sci U S A. Jul. 20, 2004;101(29):10505-10. Epub Jul. 9, 2004.
Böck et al., Selenocysteine: the 21st amino acid. Mol Microbiol. Mar. 1991;5(3):515-20.
Carroll, Genome engineering with zinc-finger nucleases. Genetics. Aug. 2011;188(4):773-82. doi: 10.1534/genetics.111.131433. Review.
Chavez et al., Precise Cas9 targeting enables genomic mutation prevention. bioRxiv. Jun. 14, 2016; http://dx/doi.oreg/10.1101/058974. 6 pages.
Chen et al., Fusion protein linkers: property, design and functionality. Adv Drug Deliv Rev. Oct. 2013;65(10):1357-69. doi:10.1016/j.addr.2012.09.039. Epub Sep. 29, 2012.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
D'Adda di Fagagna et al., The Gam protein of bacteriophage Mu is an orthologue of eukaryotic Ku. EMBO Rep. Jan. 2003;4(1):47-52.
Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.
Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.
Edwards et al., An *Escherichia coli* tyrosine transfer RNA is a leucine-specific transfer RNA in the yeast *Saccharomyces cerevisiae*. Proc Natl Acad Sci U S A. Feb. 15, 1991;88(4):1153-6.
Edwards et al., Crystal structures of the thi-box riboswitch bound to thiamine pyrophosphate analogs reveal adaptive RNA-small molecule recognition. Structure. Sep. 2006;14(9):1459-68.

(56) References Cited

OTHER PUBLICATIONS

Esvelt et al., A system for the continuous directed evolution of biomolecules. Nature. Apr. 28, 2011;472(7344):499-503. doi: 10.1038/nature09929. Epub Apr. 10, 2011.

Fagerlund et al., The Cpf1 CRISPR-Cas protein expands genome-editing tools. Genome Biology Nov. 17, 2015;16:251. https://doi.org/10.1186/s13059-015-0824-9.

Farhood et al., Codelivery to mammalian cells of a transcriptional factor with cis-acting element using cationic liposomes. Anal Biochem. Feb. 10, 1995;225(1):89-93.

Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.

Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.

Hida et al., Directed evolution for drug and nucleic acid; delivery. Adv Drug Deliv Rev. Dec. 22, 2007;59(15):1562-78. Epub Aug. 28, 2007.; Review.

Husimi, Selection and evolution of bacteriophages in cellstat. Adv Biophys. ; 1989;25:1-43. Review.

Kakiyama et al., A peptide release system using a photo-cleavable linker in a cell array format for cell-toxicity analysis. Polymer J. Feb. 27, 2013;45:535-9.

Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.

Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.

Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.

Kowal et al., Exploiting unassigned codons in Micrococcus luteus for tRNA-based amino acid mutagenesis. Nucleic Acids Res. Nov. 15, 1997;25(22):4685-9.

Kwon et al., Chemical basis of glycine riboswitch cooperativity. RNA. Jan. 2008;14(1):25-34. Epub Nov. 27, 2007.

Köhrer et al., A possible approach to site-specific insertion of two different unnatural amino acids into proteins in mammalian cells via nonsense suppression. Chem Biol. Nov. 2003;10(11):1095-102.

Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.

Lee et al., An allosteric self-splicing ribozyme triggered by a bacterial second messenger. Science. Aug. 13, 2010;329(5993):845-8. doi: 10.1126/science.1190713.

Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.

Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.

Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.

Meyer et al., Confirmation of a second natural preQ1 aptamer class in Streptococcaceae bacteria. RNA. Apr. 2008;14(4):685-95. doi: 10.1261/rna.937308. Epub Feb. 27, 2008.

Monahan et al., Site-specific incorporation of unnatural amino acids into receptors expressed in Mammalian cells. Chem Biol. Jun. 2003;10(6):573-80.

Montange et al., Structure of the S-adenosylmethionine riboswitch regulatory mRNA element. Nature. Jun. 29, 2006;441(7097):1172-5.

Mootz et al., Conditional protein splicing: a new tool to control protein structure and function in vitro and in vivo. J Am Chem Soc. Sep. 3, 2003;125(35):10561-9.

Mootz et al., Protein splicing triggered by a small molecule. J Am Chem Soc. Aug. 7, 2002;124(31):9044-5.

Neel et al., Riboswitches: Classification, function and in silico approach, International Journal of Pharma Sciences and Research. 2010;1(9):409-420.

Nelson et al., Filamentous phage DNA cloning vectors: a noninfective mutant with a nonpolar deletion in gene III. Virology. 1981; 108(2): 338-50.

Ni et al., Nucleic acid aptamers: clinical applications and promising new horizons. Curr Med Chem. 2011;18(27):4206-14. Review.

Peck et al., Directed evolution of a small-molecule-triggered intein with improved splicing properties in mammalian cells. Chem Biol. May 27, 2011;18(5):619-30. doi: 10.1016/j.chembiol.2011.02.014.

Pelletier, CRISPR-Cas systems for the study of the immune function. Nov. 15, 2016. https://doi.org/10.1002/9780470015902.a0026896.

Rakonjac et al., Roles of PIII in filamentous phage assembly. J Mol Biol. 1998; 282(1)25-41.

Riechmann et al.,. The C-terminal domain of TolA is the coreceptor for filamentous phage infection of *E. coli*. Cell. 1997; 90(2):351-60. PMID:9244308.

Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.

Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.

Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.

Serganov et al., Structural basis for discriminative regulation of gene expression by adenine-and guanine-sensing mRNAs. Chem Biol. Dec. 2004;11(12):1729-41.

Serganov et al., Structural basis for gene regulation by a thiamine pyrophosphate-sensing riboswitch. Nature. Jun. 29, 2006;441(7097):1167-71. Epub May 21, 2006.

Sharma et al., Efficient introduction of aryl bromide functionality into proteins in vivo. FEBS Lett. Feb. 4, 2000;467(1):37-40.

Skretas et al., Regulation of protein activity with small-molecule-controlled inteins. Protein Sci. Feb. 2005;14(2):523-32. Epub Jan. 4, 2005.

Smith, Filamentous fusion phage: novel expression vectors that display cloned antigens on the virion surface. Science. Jun. 14, 1985;228(4705):1315-7.

Sudarsan et al., An mRNA structure in bacteria that controls gene expression by binding lysine. Genes Dev. Nov. 1, 2003;17(21):2688-97.

Suess et al., A theophylline responsive riboswitch based on helix slipping controls gene expression in vivo. Nucleic Acids Res. Mar. 5, 2004;32(4):1610-4.

Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.

Wals et al., Unnatural amino acid incorporation in *E. coli*: current and future applications in the design of therapeutic proteins. Front Chem. Apr. 1, 2014;2:15. doi: 10.3389/fchem.2014.00015. eCollection 2014.

Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.

(56) References Cited

OTHER PUBLICATIONS

Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Yang et al., APOBEC: From mutator to editor. J Genet Genomics. Sep. 20, 2017;44(9):423-437. doi: 10.1016/j.jgg.2017.04.009. Epub Aug. 7, 2017.
Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.
Yuan et al., Laboratory-directed protein evolution. Microbiol Mol Biol Rev. 2005; 69(3):373-92. PMID: 16148303.
Zimmermann et al., Molecular interactions and metal binding in the theophylline-binding core of an RNA aptamer. RNA. May 2000;6(5):659-67.
Partial European Search Report for Application No. EP 19187331.4, dated Dec. 19, 2019.
Extended European Search Report for EP18199195.1, dated Feb. 12, 2019.
Extended European Search Report for EP 19181479.7, dated Oct. 31, 2019.
International Preliminary Report on Patentability for PCT/US2014/048390, dated Mar. 7, 2019.
International Preliminary Report on Patentability for PCT/US2017/068114, dated Jul. 4, 2019.
International Preliminary Report on Patentability for PCT/US2017/068105, dated Jul. 4, 2019.
International Preliminary Report on Patentability for PCT/US2018/021880, dated Sep. 19, 2019.
International Preliminary Report on Patentability for PCT/US2017/046144, dated Feb. 21, 2019.
International Preliminary Report on Patentability for PCT/US2017/045381, dated Feb. 14, 2019.
International Preliminary Report on Patentability for PCT/US2018/021664, dated Sep. 19, 2019.
International Preliminary Report on Patentability for PCT/US2017/056671, dated Apr. 25, 2019.
International Preliminary Report on Patentability for PCT/US2018/021878, dated Sep. 19, 2019.
International Preliminary Report on Patentability for PCT/US2018/024208, dated Oct. 3, 2019.
International Search Report for PCT/US2018/048969, dated Jul. 31, 2019.
International Preliminary Report on Patentability for PCT/US2018/032460, dated Nov. 21, 2019.
U.S. Appl. No. 61/716,256, Jinek et al., filed Oct. 19, 2012.
U.S. Appl. No. 61/717,324, Cho et al., filed Oct. 23, 2012.
U.S. Appl. No. 61/734,256, Chen et al., filed Dec. 6, 2012.
U.S. Appl. No. 61/758,624, Chen et al., filed Jan. 30, 2013.
U.S. Appl. No. 61/761,046, Knight et al., filed Feb. 5, 2013.
U.S. Appl. No. 61/794,422, Knight et al., filed Mar. 15, 2013.
U.S. Appl. No. 61/803,599, Kim et al., filed Mar. 20, 2013.
U.S. Appl. No. 61/837,481, Cho et al., filed Jun. 20, 2013.
U.S. Appl. No. 61/874,682.
U.S. Appl. No. 61/874,746.
[No Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.

[No Author Listed], Thermo Fisher Scientific—How Cationic Lipid Mediated Transfection Works, retrieved from the internet Aug. 27, 2015. 2 pages.
Abudayyeh et al., C2c2 is a single-component programmable RNA-guided RNA-targeting CRISPR effector. Science Aug. 2016;353(6299):aaf5573. DOI: 10.1126/science.aaf5573.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Alexandrov et al., Signatures of mutational processes in human cancer. Nature. Aug. 22, 2013;500(7463):415-21. doi: 10.1038/nature12477. Epub Aug. 14, 2013.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Arnold et al., Mutants of Tn3 resolvase which do not require accessory binding sites for recombination activity. EMBO J. Mar. 1, 1999;18(5):1407-14.
Barnes et al., Repair and genetic consequences of endogenous DNA base damage in mammalian cells. Annu Rev Genet. 2004;38:445-76.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.
Beale et al., Comparison of the differential context-dependence of DNA deamination by APOBEC enzymes: correlation with mutation spectra in vivo. J Mol Biol. Mar. 26, 2004;337(3):585-96.
Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.
Beumer et al., Efficient gene targeting in Drosophila with zinc-finger nucleases. Genetics. Apr. 2006;172(4):2391-403. Epub Feb. 1, 2006.
Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel.2017.08.008. Epub Sep. 7, 2017.
Birling et al., Site-specific recombinases for manipulation of the mouse genome. Methods Mol Biol. 2009;561:245-63. doi: 10.1007/978-1-60327-019-9_16.
Bitinaite et al., FokI dimerization is required for DNA cleavage. Proc Natl Acad Sci U S A. Sep. 1, 1998;95(18):10570-5.
Boch, TALEs of genome targeting. Nat Biotechnol. Feb. 2011;29(2):135-6. Doi: 10.1038/nbt.1767.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Bolotin et al., Clustered regularly interspaced short palindrome repeats (CRISPRs) have spacers of extrachromosomal origin. Microbiology. Aug. 2005;151(Pt 8):2551-61.
Borman, Improved route to single-base genome editing. Chemical & Engineering News, Apr. 25, 2016;94(17)p5. http://cen.acs.org/articles/94/i17/Improved-route-single-base-genome.html.
Branden and Tooze, Introduction to Protein Structure. 1999; 2nd edition. Garland Science Publisher: 3-12.
Briner et al., Guide RNA functional modules direct Cas9 activity and orthogonality. Mol Cell. Oct. 23, 2014;56(2):333-339. doi: 10.1016/j.molcel.2014.09.019.
Britt et al., Re-engineering plant gene targeting. Trends Plant Sci. Feb. 2003;8(2):90-5.
Brouns et al., Small CRISPR RNAs guide antiviral defense in prokaryotes. Science. Aug. 15, 2008;321(5891):960-4. doi: 10.1126/science.1159689.

(56) References Cited

OTHER PUBLICATIONS

Brown et al., Serine recombinases as tools for genome engineering. Methods. Apr. 2011;53(4):372-9. doi: 10.1016/j.ymeth.2010.12.031. Epub Dec. 30, 2010.

Brusse et al., Spinocerebellar ataxia associated with a mutation in the fibroblast growth factor 14 gene (SCA27): A new phenotype. Mov Disord. Mar. 2006;21(3):396-401.

Buchholz et al., Alteration of Cre recombinase site specificity by substrate-linked protein evolution. Nat Biotechnol. Nov. 2001;19(11):1047-52.

Buchwald et al., Long-term, continuous intravenous heparin administration by an implantable infusion pump in ambulatory patients with recurrent venous thrombosis. Surgery. Oct. 1980;88(4):507-16.

Bulow et al., Multienzyme systems obtained by gene fusion. Trends Biotechnol. Jul. 1991;9(7):226-31.

Burstein et al., New CRISPR-Cas systems from uncultivated microbes. Nature Feb. 2017;542(7640):237-240.

Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.

Caldecott et al., Single-strand break repair and genetic disease. Nat Rev Genet. Aug. 2008;9(8):619-31. doi: 10.1038/nrg2380.

Cameron, Recent advances in transgenic technology. Mol Biotechnol. Jun. 1997;7(3):253-65.

Cargill et al., Characterization of single-nucleotide polymorphisms in coding regions of human genes. Nat Genet. Jul. 1999;22(3):231-8.

Caron et al., Intracellular delivery of a Tat-eGFP fusion protein into muscle cells. Mol Ther. Mar. 2001;3(3):310-8.

Carroll et al., Gene targeting in Drosophila and Caenorhabditis elegans with zinc-finger nucleases. Methods Mol Biol. 2008;435:63-77. doi: 10.1007/978-1-59745-232-8_5.

Carroll et al., Progress and prospects: zinc-finger nucleases as gene therapy agents. Gene Ther. Nov. 2008;15(22):1463-8. doi: 10.1038/gt.2008.145. Epub Sep. 11, 2008.

Carroll, A CRISPR approach to gene targeting. Mol Ther. Sep. 2012;20(9):1658-60. doi: 10.1038/mt.2012.171.

Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.

Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.

Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.

Charpentier et al., Biotechnology: Rewriting a genome. Nature. Mar. 7, 2013;495(7439):50-1. doi: 10.1038/495050a.

Chavez et al., Highly efficient Cas9-mediated transcriptional programming. Nat Methods. Apr. 2015;12(4):326-8. doi: 10.1038/nmeth.3312. Epub Mar. 2, 2015.

Chavez et al., Precise Cas9 targeting enables genomic mutation prevention. Jun. 14, 2016. doi:https://doi.org/10.1101/058974. [Preprint].

Chavez et al., Precise Cas9 targeting enables genomic mutation prevention. Proc Natl Acad Sci U S A. Apr. 3, 2018;115(14):3669-3673. doi: 10.1073/pnas.1718148115. Epub Mar. 19, 2018.

Chavez et al., Therapeutic applications of the PhiC31 integrase system. Curr Gene Ther. Oct. 2011;11(5):375-81. Review.

Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.

Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.

Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.

Chesnoy et al., Structure and function of lipid-DNA complexes for gene delivery. Annu Rev Biophys Biomol Struct. 2000;29:27-47.

Chew et al., A multifunctional AAV-CRISPR-Cas9 and its host response. Nat Methods. Oct. 2016;13(10):868-74. doi: 10.1038/nmeth.3993. Epub Sep. 5, 2016.

Chichili et al., Linkers in the structural biology of protein-protein interactions. Protein Science. 2013;22:153-67.

Chipev et al., A leucine—proline mutation in the H1 subdomain of keratin 1 causes epidermolytic hyperkeratosis. Cell. Sep. 4, 1992;70(5):821-8.

Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.

Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.

Christian et al, Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.

Christian et al., Targeting DNA double-strand breaks with TAL effector nucleases. Genetics. Oct. 2010;186(2):757-61. Doi: 10.1534/genetics.110.120717. Epub Jul. 26, 2010.

Chu et al., Increasing the efficiency of homology-directed repair for CRISPR-Cas9-induced precise gene editing in mammalian cells. Nat Biotech. Feb. 13, 2015;33:543-8.

Chung-Il et al., Artificial control of gene expression in mammalian cells by modulating RNA interference through aptamer-small molecule interaction. RNA. May 2006;12(5):710-6. Epub Apr. 10, 2006.

Chylinski et al., The tracrRNA and Cas9 families of type II CRISPR-Cas immunity systems. RNA Biol. May 2013;10(5):726-37. doi: 10.4161/rna.24321. Epub Apr. 5, 2013.

Cole-Strauss et al., Correction of the mutation responsible for sickle cell anemia by an RNA-DNA oligonucleotide. Science. Sep. 6, 1996;273(5280):1386-9.

Cong et al., Multiplex genome engineering using CRISPR/Cas systems. Science. Feb. 15, 2013;339(6121):819-23. doi: 10.1126/science.1231143. Epub Jan. 3, 2013.

Conticello, The AID/APOBEC family of nucleic acid mutators. Genome Biol. 2008;9(6):229. doi: 10.1186/gb-2008-9-6-229. Epub Jun. 17, 2008.

Covino et al., The CCL2/CCR2 Axis in the Pathogenesis of HIV-1 Infection: A New Cellular Target for Therapy? Current Drug Targets Dec. 2016;17(1):76-110. DOI: 10.2174/1389450117011511217110917.

Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.

Cox et al., Therapeutic genome editing: prospects and challenges. Nat Med. Feb. 2015;21(2):121-31. doi: 10.1038/nm.3793.

Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.

Cradick et al., ZFN-site searches genomes for zinc finger nuclease target sites and off-target sites. BMC Bioinformatics. May 13, 2011;12:152. doi: 10.1186/1471-2105-12-152.

Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.

Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.

Cunningham et al., Ensembl 2015. Nucleic Acids Res. Jan. 2015;43(Database issue):D662-9. doi: 10.1093/nar/gku1010. Epub Oct. 28, 2014.

(56) References Cited

OTHER PUBLICATIONS

Dahlem et al., Simple methods for generating and detecting locus-specific mutations induced with TALENs in the zebrafish genome. PLoS Genet. 2012;8(8):e1002861. doi: 10.1371/journal.pgen. 1002861. Epub Aug. 16, 2012.
Davis et al., DNA double strand break repair via non-homologous end-joining. Transl Cancer Res. Jun. 2013;2(3):130-143.
Davis et al., Small molecule-triggered Cas9 protein with improved genome-editing specificity. Nat Chem Biol. May 2015;11(5):316-8. doi: 10.1038/nchembio.1793. Epub Apr. 6, 2015.
De Souza, Primer: genome editing with engineered nucleases. Nat Methods. Jan. 2012;9(1):27.
Deltcheva et al., CRISPR RNA maturation by trans-encoded small RNA and host factor RNase III. Nature. Mar. 31, 2011;471(7340):602-7. doi: 10.1038/nature09886.
DiCarlo et al., Genome engineering in *Saccharomyces cerevisiae* using CRISPR-Cas systems. Nucleic Acids Research Apr. 2013;41(7):4336-43.
Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.
Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.
Doench et al., Optimized sgRNA design to maximize activity and minimize off-target effects of CRISPR-Cas9. Nat Biotechnol. Feb. 2016;34(2):184-191. doi: 10.1038/nbt.3437.
Dormiani et al., Long-term and efficient expression of human β-globin gene in a hematopoietic cell line using a new site-specific integrating non-viral system. Gene Ther. Aug. 2015;22(8):663-74. doi: 10.1038/gt.2015.30. Epub Apr. 1, 2015.
Doudna et al., Genome editing. The new frontier of genome engineering with CRISPR-Cas9. Science. Nov. 28, 2014;346(6213):1258096. doi: 10.1126/science.1258096.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
During et al., Controlled release of dopamine from a polymeric brain implant: in vivo characterization. Ann Neurol. Apr. 1989;25(4):351-6.
East-Seletsky et al., Two distinct RNase activities of CRISPR-C2c2 enable guide-RNA processing and RNA detection. Nature Oct. 2016;538(7624):270-3.
Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.
Endo et al., Toward establishing an efficient and versatile gene targeting system in higher plants. Biocatalysis and Agricultural Biotechnology 2014;3,(1):2-6.
Esvelt et al., Genome-scale engineering for systems and synthetic biology. Mol Syst Biol. 2013;9:641. doi: 10.1038/msb.2012.66.
Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.
Extended European Search Report for EP 15830407.1, dated Mar. 2, 2018.
Fang et al., Synthetic Studies Towards Halichondrins: Synthesis of the Left Halves of Norhalichondrins and Homohalichondrins. Tetrahedron Letters 1992;33(12):1557-1560.
Ferry et al., Rational design of inducible CRISPR guide RNAs for de novo assembly of transcriptional programs. Nat Commun. Mar. 3, 2017;8:14633. doi: 10.1038/ncomms14633.
Fine et al., Trans-spliced Cas9 allows cleavage of HBB and CCR5 genes in human cells using compact expression cassettes. Scientific Reports 2015;5(1):Article No. 10777. doi:10.1038/srep10777. With Supplementary Information.
Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013.
Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fuchs et al., Polyarginine as a multifunctional fusion tag. Protein Sci. Jun. 2005;14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fukui et al., DNA Mismatch Repair in Eukaryotes and Bacteria. J Nucleic Acids. Jul. 27, 2010;2010. pii: 260512. doi: 10.4061/2010/260512.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gardlik et al., Vectors and delivery systems in gene therapy. Med Sci Monit. Apr. 2005;11(4):RA110-21. Epub Mar. 24, 2005.
Garneau et al., The CRISPR/Cas bacterial immune system cleaves bacteriophage and plasmid DNA. Nature. Nov. 4, 2010;468(7320):67-71. doi: 10.1038/nature09523.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Genbank Submission; NIH/NCBI, Accession No. J04623. Kita et al., Apr. 26, 1993. 2 pages.
Genbank Submission; NIH/NCBI, Accession No. NC_002737.1. Ferretti et al., Jun. 27, 2013. 1 page.
Genbank Submission; NIH/NCBI, Accession No. NC_015683.1. Trost et al., Jul. 6, 2013. 1 page.
Genbank Submission; NIH/NCBI, Accession No. NC_016782.1. Trost et al., Jun. 11, 2013. 1 page.
Genbank Submission; NIH/NCBI, Accession No. NC_016786.1. Trost et al., Aug. 28, 2013. 1 page.
Genbank Submission; NIH/NCBI, Accession No. NC_017053.1. Fittipaldi et al., Jul. 6, 2013. 1 page.
Genbank Submission; NIH/NCBI, Accession No. NC_017317.1. Trost et al., Jun. 11, 2013. 1 page.

(56) References Cited

OTHER PUBLICATIONS

Genbank Submission; NIH/NCBI, Accession No. NC_017861.1. Heidelberg et al., Jun. 11, 2013. 1 page.
Genbank Submission; NIH/NCBI, Accession No. NC_018010.1. Lucas et al., Jun. 11, 2013. 2 pages.
Genbank Submission; NIH/NCBI, Accession No. NC_018721.1. Feng et al., Jun. 11, 2013. 1 pages.
Genbank Submission; NIH/NCBI, Accession No. NC_021284.1. Ku et al., Jul. 12, 2013. 1 page.
Genbank Submission; NIH/NCBI, Accession No. NC_021314.1. Zhang et al., Jul. 15, 2013. 1 page.
Genbank Submission; NIH/NCBI, Accession No. NC_021846.1. Lo et al., Jul. 22, 2013. 1 page.
Genbank Submission; NIH/NCBI, Accession No. NP_472073.1. Glaser et al., Jun. 27, 2013. 2 pages.
Genbank Submission; NIH/NCBI, Accession No. P42212. Prasher et al., Mar. 19, 2014. 7 pages.
Genbank Submission; NIH/NCBI, Accession No. YP_002342100.1. Bernardini et al., Jun. 10, 2013. 2 pages.
Genbank Submission; NIH/NCBI, Accession No. YP_002344900.1. Gundogdu et al., Mar. 19, 2014. 2 pages.
Genbank Submission; NIH/NCBI, Accession No. YP_820832.1. Makarova et al., Aug. 27, 2013. 2 pages.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Guo et al., Protein tolerance to random amino acid change. Proc Natl Acad Sci U S A. Jun. 22, 2004;101(25):9205-10. Epub Jun. 14, 2004.
Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.
Hale et al., RNA-guided RNA cleavage by a CRISPR RNA-Cas protein complex. Cell. Nov. 25, 2009;139(5):945-56. doi: 10.1016/j.cell.2009.07.040.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.
Harris et al., RNA editing enzyme APOBEC1 and some of its homologs can act as DNA mutators. Mol Cell. Nov. 2002;10(5):1247-53.
Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Heller et al., Replisome assembly and the direct restart of stalled replication forks. Nat Rev Mol Cell Biol. Dec. 2006;7(12):932-43. Epub Nov. 8, 2006.
Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.
Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.
Hill et al., Functional analysis of conserved histidines in ADP-glucose pyrophosphorylase from *Escherichia coli*.Biochem Biophys Res Commun. Mar. 17, 1998;244(2):573-7.
Hilton et al., Enabling functional genomics with genome engineering. Genome Res. Oct. 2015;25(10):1442-55. doi: 10.1101/gr.190124.115.
Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.
Hockemeyer et al., Genetic engineering of human pluripotent cells using TALE nucleases. Nat Biotechnol. Jul. 7, 2011;29(8):731-4. doi: 10.1038/nbt.1927.
Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.
Hondares et al., Peroxisome Proliferator-activated Receptor $\alpha$ (PPAR$\alpha$) Induces PPAR$\gamma$ Coactivator 1$\alpha$ (PGC-1$\alpha$) Gene Expression and Contributes to Thermogenic Activation of Brown Fat. J Biol. Chem Oct. 2011; 286(50):43112-22. doi: 10.1074/jbc.M111.252775.
Horvath et al., CRISPR/Cas, the immune system of bacteria and archaea. Science. Jan. 8, 2010;327(5962):167-70. doi: 10.1126/science.1179555.
Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.
Houdebine, The methods to generate transgenic animals and to control transgene expression. J Biotechnol. Sep. 25, 2002;98(2-3):145-60.
Howard et al., Intracerebral drug delivery in rats with lesion-induced memory deficits. J Neurosurg. Jul. 1989;71(1):105-12.
Hower et al., Shape-based peak identification for ChIP-Seq. BMC Bioinformatics. Jan. 12, 2011;12:15. doi: 10.1186/1471-2105-12-15.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013.
Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.
Huang et al., Heritable gene targeting in zebrafish using customized TALENs. Nat Biotechnol. Aug. 5, 2011;29(8):699-700. doi: 10.1038/nbt.1939.
Humbert et al., Targeted gene therapies: tools, applications, optimization. Crit Rev Biochem Mol Biol. May-Jun. 2012;47(3):264-81. doi: 10.3109/10409238.2012.658112.
Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.

(56) References Cited

OTHER PUBLICATIONS

Hwang et al., Efficient In Vivo Genome Editing Using RNA-Guided Nucleases. Nat Biotechnol. Mar. 2013;31(3): 227-229. doi: 10.1038/nbt.2501. Epub Jan. 29, 2013.
Ikediobi et al., Mutation analysis of 24 known cancer genes in the NCI-60 cell line set. Mol Cancer Ther. Nov. 2006;5(11):2606-12. Epub Nov. 6, 2006.
International Preliminary Report on Patentability for PCT/US2016/058344, dated May 3, 2018.
International Preliminary Report on Patentability for PCT/US2012/047778, dated Feb. 6, 2014.
International Preliminary Report on patentability for PCT/US2014/050283, dated Feb. 18, 2016.
International Preliminary Report on Patentability for PCT/US2014/052231, dated Mar. 3, 2016.
International Preliminary Report on Patentability for PCT/US2014/054247, dated Mar. 17, 2016.
International Preliminary Report on Patentability for PCT/US2014/054291, dated Mar. 17, 2016.
International Preliminary Report on Patentability for PCT/US2014/070038, dated Jun. 23, 2016.
International Preliminary Report on Patentability for PCT/US2015/042770, dated Dec. 19, 2016.
International Preliminary Report on Patentability for PCT/US2015/058479, dated May 11, 2017.
International Preliminary Report on Patentability or PCT/US2014/054252, dated Mar. 17, 2016.
International Search Report and Written Opinion for PCT/US2012/047778, dated May 30, 2013.
International Search Report and Written Opinion for PCT/US2014/050283, dated Nov. 6, 2014.
International Search Report and Written Opinion for PCT/US2014/052231, dated Dec. 4, 2014.
International Search Report and Written Opinion for PCT/US2014/052231, dated Jan. 30, 2015 (Corrected Version).
International Search Report and Written Opinion for PCT/US2014/054247, dated Mar. 27, 2015.
International Search Report and Written Opinion for PCT/US2014/054252, dated Mar. 5, 2015.
International Search Report and Written Opinion for PCT/US2014/054291, dated Mar. 27, 2015.
International Search Report and Written Opinion for PCT/US2014/070038, dated Apr. 14, 2015.
International Search Report and Written Opinion for PCT/US2015/042770, dated Feb. 23, 2016.
International Search Report and Written Opinion for PCT/US2015/058479, dated Feb. 11, 2016.
International Search Report and Written Opinion for PCT/US2016/044546, dated Dec. 28, 2016.
International Search Report and Written Opinion for PCT/US2016/058344, dated Apr. 20, 2017.
International Search Report and Written Opinion for PCT/US2017/045381, dated Oct. 26, 2017.
International Search Report and Written Opinion for PCT/US2017/046144, dated Oct. 10, 2017.
International Search Report and Written Opinion for PCT/US2017/056671, dated Feb. 20, 2018.
International Search Report and Written Opinion for PCT/US2017/068105, dated Apr. 4, 2018.
International Search Report and Written Opinion for PCT/US2017/068114, dated Mar. 20, 2018.
International Search Report and Written Opinion for PCT/US2017/48390, dated Jan. 9, 2018.
International Search Report for PCT/US2013/032589, dated Jul. 26, 2013.
International Search Report for PCT/US2018/021664, dated Jun. 21, 2018.
International Search Report for PCT/US2018/021878, dated Aug. 20, 2018.
International Search Report for PCT/US2018/021880, dated Jun. 20, 2018.
International Search Report for PCT/US2018/024208, dated Aug. 23, 2018.
International Search Report for PCT/US2018/025887, dated Jun. 21, 2018.
International Search Report for PCT/US2018/032460, dated Jul. 11, 2018.
Invitation to Pay Additional Fees for PCT/US2014/054291, mailed Dec. 18, 2014.
Invitation to Pay Additional Fees for PCT/US2016/058344, mailed Mar. 1, 2017.
Invitation to Pay Additional Fees for PCT/US2017/056671, mailed Dec. 21, 2017.
Invitation to Pay Additional Fees for PCT/US2017/48390, mailed Nov. 7, 2017.
Invitation to Pay Additional Fees for PCT/US2018/021878, mailed Jun. 8, 2018.
Irrthum et al., Congenital hereditary lymphedema caused by a mutation that inactivates VEGFR3 tyrosine kinase. Am J Hum Genet. Aug. 2000;67(2):295-301. Epub Jun. 9, 2000.
Ishino et al., Nucleotide sequence of the iap gene, responsible for alkaline phosphatase isozyme conversion in *Escherichia coli*, and identification of the gene product. J Bacteriol. Dec. 1987;169(12):5429-33.
Jamieson et al., Drug discovery with engineered zinc-finger proteins. Nat Rev Drug Discov. May 2003;2(5):361-8.
Jansen et al., Backbone and nucleobase contacts to glucosamine-6-phosphate in the glmS ribozyme. Nat Struct Mol Biol. Jun. 2006;13(6):517-23. Epub May 14, 2006.
Jansen et al., Identification of genes that are associated with DNA repeats in prokaryotes. Mol Microbiol. Mar. 2002;43(6):1565-75.
Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.
Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.
Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Jinek et al., Structures of Cas9 endonucleases reveal RNA-mediated conformational activation. Science. Mar. 14, 2014;343(6176):1247997. doi: 10.1126/science.1247997. Epub Feb. 6, 2014.
Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
Joung et al.,TALENs: a widely applicable technology for targeted genome editing. Nat Rev Mol Cell Biol. Jan. 2013;14(1):49-55. doi: 10.1038/nrm3486. Epub Nov. 21, 2012.
Kaiser et al., Gene therapy. Putting the fingers on gene repair. Science. Dec. 23, 2005;310(5756):1894-6.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Kappel et al., Regulating gene expression in transgenic animals. Curr Opin Biotechnol. Oct. 1992;3(5):548-53.
Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.
Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.

(56) References Cited

OTHER PUBLICATIONS

Kaya et al., A bacterial Argonaute with noncanonical guide RNA specificity. Proc. Natl. Acad. Sci. USA Apr. 2016;113(15):4057-62.
Kellendonk et al., Regulation of Cre recombinase activity by the synthetic steroid RU 486. Nucleic Acids Res. Apr. 15, 1996;24(8):1404-11.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., Genome-wide target specificities of CRISPR RNA-guided programmable deaminases. Nat Biotechnol. May 2017;35(5):475-480. doi: 10.1038/nbt.3852. Epub Apr. 10, 2017.
Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Kim et al., The role of apolipoprotein E in Alzheimer's disease. Neuron. Aug. 13, 2009;63(3):287-303. doi: 10.1016/j.neuron.2009.06.026.
Kim et al., Transcriptional repression by zinc finger peptides. Exploring the potential for applications in gene therapy. J Biol Chem. Nov. 21, 1997;272(47):29795-800.
Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.
Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.
Komor et al., CRISPR-Based Technologies for the Manipulation of Eukaryotic Genomes. Cell. Jan. 12, 2017;168(1-2):20-36. doi: 10.1016/j.cell.2016.10.044.
Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.
Komor et al., Programmable editing of a target base in genomic DNA without double-stranded DNA cleavage. Nature. Apr. 20, 2016;533(7603):420-4. doi: 10.1038/nature17946.
Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.
Kumar et al., Structural and functional consequences of the mutation of a conserved arginine residue in alphaA and alphaB crystallins. J Biol Chem. Aug. 20, 1999;274(34):24137-41.
Kundu et al., Leucine to proline substitution by SNP at position 197 in Caspase-9 gene expression leads to neuroblastoma: a bioinformatics analysis. 3 Biotech. 2013; 3:225-34.
Kunz et al., DNA Repair in mammalian cells: Mismatched repair: variations on a theme. Cell Mol Life Sci. Mar. 2009;66(6):1021-38. doi: 10.1007/s00018-009-8739-9.
Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.
Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.
Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.
Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.
Langer et al., Chemical and Physical Structure of Polymers as Carriers for Controlled Release of Bioactive Agents: A Review. Journal of Macromolecular Science, 2006;23(1):61-126. Doi: 10.1080/07366578308079439.
Langer et al., New methods of drug delivery. Science. Sep. 28, 1990;249(4976):1527-33.
Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.
Lau et al., Molecular basis for discriminating between normal and damaged bases by the human alkyladenine glycosylase, AAG. Proc Natl Acad Sci U S A. Dec. 5, 2000;97(25):13573-8.
Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.
Lawrence et al., Supercharging proteins can impart unusual resilience. J Am Chem Soc. Aug. 22, 2007;129(33):10110-2. Epub Aug. 1, 2007.
Lazar et al., Transforming growth factor alpha: mutation of aspartic acid 47 and leucine 48 results in different biological activities. Mol Cell Biol. Mar. 1988;8(3):1247-52.
Ledford, Gene-editing hack yields pinpoint precision. Nature, Apr. 20, 2016. http://www.nature.com/news/gene-editing-hack-yields-pinpoint-precision-1.19773.
Lee et al., A chimeric thyroid hormone receptor constitutively bound to DNA requires retinoid X receptor for hormone-dependent transcriptional activation in yeast. Mol Endocrinol. Sep. 1994;8(9):1245-52.
Lee et al., Failure to detect DNA-guided genome editing using Natronobacterium gregoryi Argonaute. Nat Biotechnol. Nov. 28, 2016;35(1):17-18. doi: 10.1038/nbt.3753.
Lee et al., PIK3CA gene is frequently mutated in breast carcinomas and hepatocellular carcinomas. Oncogene. Feb. 17, 2005;24(8):1477-80.
Lee et al., Recognition of liposomes by cells: in vitro binding and endocytosis mediated by specific lipid headgroups and surface charge density. Biochim Biophys Acta. Jan. 31, 1992;1103(2):185-97.

(56) References Cited

OTHER PUBLICATIONS

Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.
Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.
Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.
Levy et al., Inhibition of calcification of bioprosthetic heart valves by local controlled-release diphosphonate. Science. Apr. 12, 1985;228(4696):190-2.
Lewis et al., A serum-resistant cytofectin for cellular delivery of antisense oligodeoxynucleotides and plasmid DNA. Proc Natl Acad Sci U S A. Apr. 16, 1996;93(8):3176-81.
Lewis et al., Building the Class 2 CRISPR-Cas Arsenal. Mol Cell 2017;65(3);377-379.
Lewis et al., Codon 129 polymorphism of the human prion protein influences the kinetics of amyloid formation. J Gen Virol. Aug. 2006;87(Pt 8):2443-9.
Li et al., Base editing with a Cpf1-cytidine deaminase fusion. Nat Biotechnol. Apr. 2018;36(4):324-327. doi: 10.1038/nbt.4102. Epub Mar. 19, 2018.
Li et al., Current approaches for engineering proteins with diverse biological properties. Adv Exp Med Biol. 2007;620:18-33.
Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.
Li et al., Highly efficient and precise base editing in discarded human tripronuclear embryos. Protein Cell. Aug. 19, 2017. doi: 10.1007/s13238-017-0458-7. [Epub ahead of print].
Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.
Li et al., Multiplex and homologous recombination-mediated genome editing in Arabidopsis and Nicotiana benthamiana using guide RNA and Cas9. Nat Biotechnol. Aug. 2013;31(8):688-91. doi: 10.1038/nbt.2654.
Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.
Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.
Lieber et al., Mechanism and regulation of human non-homologous DNA end-joining. Nat Rev Mol Cell Biol. Sep. 2003;4(9):712-20.
Lin et al., Enhanced homology-directed human genome engineering by controlled timing of CRISPR/Cas9 delivery. Elife. Dec. 15, 2014;3:e04766. doi: 10.7554/eLife.04766.
Liu et al., C2c1-sgRNA Complex Structure Reveals RNA-Guided DNA Cleavage Mechanism. Molecular Cell Jan. 2017;65(2):310-22.
Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.
Liu et al., Balancing AID and DNA repair during somatic hypermutation. Trends Immunol. Apr. 2009;30(4):173-81. doi: 10.1016/j.it.2009.01.007.
Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.
Liu et al., Design of polydactyl zinc-finger proteins for unique addressing within complex genomes. Proc Natl Acad Sci U S A. May 27, 1997;94(11):5525-30.
Liu et al., Distance determination by GIY-YIG intron endonucleases: discrimination between repression and cleavage functions. Nucleic Acids Res. Mar. 31, 2006;34(6):1755-64. Print 2006.
Liu et al., Fast Colorimetric Sensing of Adenosine and Cocaine Based on a General Sensor Design Involving Aptamers and Nanoparticles. Angew Chem. 2006;118(1):96-100.
Lombardo et al., Gene editing in human stem cells using zinc finger nucleases and integrase-defective lentiviral vector delivery. Nat Biotechnol. Nov. 2007;25(11):1298-306. Epub Oct. 28, 2007.
Losey et al., Crystal structure of *Staphylococcus sureus* tRNA adenosine deaminase tadA in complex with RNA. Nature Struct. Mol. Biol. Feb. 2006;13(2):153-9.
Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.
Lundberg et al., Delivery of short interfering RNA using endosomolytic cell-penetrating peptides. Faseb J. Sep. 2007;21(11):2664-71. Epub Apr. 26, 2007.
Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.
Lyons et al., Efficient Recognition of an Unpaired Lesion by a DNA Repair Glycosylase. J. Am. Chem. Soc., 2009;131(49):17742-3. Doi: 10.1021/ja908378y.
Ma et al., Targeted AID-mediated mutagenesis (TAM) enables efficient genomic diversification in mammalian cells. Nature Methods. Oct. 2016;13:1029-35. doi:10.1038/nmeth.4027.
Maeder et al., CRISPR RNA-guided activation of endogenous human genes. Nat Methods. Oct. 2013;10(10):977-9. doi: 10.1038/nmeth.2598. Epub Jul. 25, 2013.
Maeder et al., Rapid "open-source" engineering of customized zinc-finger nucleases for highly efficient gene modification. Mol Cell. Jul. 25, 2008;31(2):294-301. doi:10.1016/j.molce1.2008.06.016.
Maeder et al., Robust, synergistic regulation of human gene expression using TALE activators. Nat Methods. Mar. 2013;10(3):243-5. doi: 10.1038/nmeth.2366. Epub Feb. 10, 2013.
Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.
Makarova et al., Prokaryotic homologs of Argonaute proteins are predicted to function as key components of a novel system of defense against mobile genetic elements. Biology Direct 2009;4:29.
Makarova et al., An updated evolutionary classification of CRISPR-Cas systems. Nat Rev Microbiol. Nov. 2015;13(11):722-36. doi: 10.1038/nrmicro3569. Epub Sep. 28, 2015.
Makarova et al., Evolution and classification of the CRISPR-Cas systems. Nat Rev Microbiol. Jun. 2011;9(6):467-77. doi: 10.1038/nrmicro2577. Epub May 9, 2011.
Mali et al., Cas9 as a versatile tool for engineering biology. Nat Methods. Oct. 2013;10(10):957-63. doi: 10.1038/nmeth.2649.
Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.
Mali et al., RNA-guided human genome engineering via Cas9. Science. Feb. 15, 2013;339(6121):823-6. doi: 10.1126/science.1232033. Epub Jan. 3, 2013.
Mani et al., Design, engineering, and characterization of zinc finger nucleases. Biochem Biophys Res Commun. Sep. 23, 2005;335(2):447-57.
Marioni et al., DNA methylation age of blood predicts all-cause mortality in later life. Genome Biol. Jan. 30, 2015;16:25. doi: 10.1186/s13059-015-0584-6.
Marraffini et al., CRISPR interference limits horizontal gene transfer in staphylococci by targeting DNA. Science. Dec. 19, 2008;322(5909):1843-5. doi: 10.1126/science.1165771.

(56) References Cited

OTHER PUBLICATIONS

Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.
Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.
Meng et al., Targeted gene inactivation in zebrafish using engineered zinc-finger nucleases. Nat Biotechnol. Jun. 2008;26(6):695-701. doi: 10.1038/nbt1398. Epub May 25, 2008.
Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.
Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.
Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.
Miller et al., A TALE nuclease architecture for efficient genome editing. Nat Biotechnol. Feb. 2011;29(2):143-8. doi:10.1038/nbt.1755. Epub Dec. 22, 2010.
Miller et al., An improved zinc-finger nuclease architecture for highly specific genome editing. Nat Biotechnol. Jul. 2007;25(7):778-85. Epub Jul. 1, 2007.
Minoche et al., Evaluation of genomic high-throughput sequencing data generated on Illumina HiSeq and genome analyzer systems. Genome Biol. Nov. 8, 2011;12(11):R112. doi: 10.1186/gb-2011-12-11-r112.
Minoretti et al., A W148R mutation in the human FOXD4 gene segregating with dilated cardiomyopathy, obsessive-compulsive disorder, and suicidality. Int J Mol Med. Mar. 2007;19(3):369-72.
Mojica et al., Intervening sequences of regularly spaced prokaryotic repeats derive from foreign genetic elements. J Mol Evol. Feb. 2005;60(2):174-82.
Mol et al., Crystal structure of human uracil-DNA glycosylase in complex with a protein inhibitor: protein mimicry of DNA. Cell. Sep. 8, 1995;82(5):701-8.
Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.
Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.
Morris et al., A peptide carrier for the delivery of biologically active proteins into mammalian cells. Nat Biotechnol. Dec. 2001;19(12):1173-6.
Moscou et al., A simple cipher governs DNA recognition by TAL effectors. Science. Dec. 11, 2009;326(5959):1501. doi: 10.1126/science.1178817.
Mullins et al., Transgenesis in nonmurine species. Hypertension. Oct. 1993;22(4):630-3.
Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.
Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.
Nahvi et al., Coenzyme B12 riboswitches are widespread genetic control elements in prokaryotes. Nucleic Acids Res. Jan. 2, 2004;32(1):143-50.
Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.
Navaratnam et al., An overview of cytidine deaminases. Int J Hematol. Apr. 2006;83(3):195-200.
NCBI Reference Sequence: NM_002427.3. Wu et al., May 3, 2014. 5 pages.
Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.
Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.
Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.
Noris et al., A phenylalanine-55 to serine amino-acid substitution in the human glycoprotein IX leucine-rich repeat is associated with Bernard-Soulier syndrome. Br J Haematol. May 1997;97(2):312-20.
O'Connell et al., Programmable RNA recognition and cleavage by CRISPR/Cas9. Nature. Dec. 11, 2014;516(7530):263-6. doi: 10.1038/nature13769. Epub Sep. 28, 2014.
Offord, Advances in Genome Editing. The Scientist, Apr. 20, 2016. http://www.the-scientist.com/?articles.view/articleNo/45903/title/Advances-in-Genome-Editing/.
Osborn et al., TALEN-based gene correction for epidermolysis bullosa. Mol Ther. Jun. 2013;21(6):1151-9. doi: 10.1038/mt.2013.56. Epub Apr. 2, 2013.
Pan et al., Biological and biomedical applications of engineered nucleases. Mol Biotechnol. Sep. 2013;55(1):54-62. doi: 10.1007/s12033-012-9613-9.
Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.
Partial Supplementary European Search Report for Application No. Ep 12845790.0, dated Mar. 18, 2015.
Pattanayak et al., Determining the specificities of TALENs, Cas9, and other genome-editing enzymes. Methods Enzymol. 2014;546:47-78. doi: 10.1016/B978-0-12-801185-0.00003-9.
Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.
Pattanayak et al., Revealing off-target cleavage specificities of zinc-finger nucleases by in vitro selection. Nat Methods. Aug. 7, 2011;8(9):765-70. doi: 10.1038/nmeth.1670.
Pavletich et al., Zinc finger-DNA recognition: crystal structure of a Zif268-DNA complex at 2.1 A. Science. May 10, 1991;252(5007):809-17.
Pearl, Structure and function in the uracil-DNA glycosylase superfamily. Mutat Res. Aug. 30, 2000;460(3-4):165-81.
Pennisi et al., The CRISPR craze. Science. Aug. 23, 2013;341(6148):833-6. doi: 10.1126/science.341.6148.833.
Pennisi et al., The tale of the TALEs. Science. Dec. 14, 2012;338(6113):1408-11. doi: 10.1126/science.338.6113.1408.
Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.
Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.
Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.
Petek et al., Frequent endonuclease cleavage at off-target locations in vivo. Mol Ther. May 2010;18(5):983-6. Doi: 10.1038/mt.2010.35. Epub Mar. 9, 2010.
Petolino et al., Editing Plant Genomes: a new era of crop improvement. Plant Biotechnol J. Feb. 2016;14(2):435-6. doi: 10.1111/pbi.12542.
Phillips, The challenge of gene therapy and DNA delivery. J Pharm Pharmacol. Sep. 2001;53(9):1169-74.

(56) References Cited

OTHER PUBLICATIONS

Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.
Plosky et al., CRISPR-Mediated Base Editing without DNA Double-Strand Breaks. Mol Cell. May 19, 2016;62(4):477-8. doi: 10.1016/j.molcel.2016.05.006.
Pluciennik et al., PCNA function in the activation and strand direction of MutLα endonuclease in mismatch repair. Proc Natl Acad Sci U S A. Sep. 14, 2010;107(37):16066-71. doi: 10.1073/pnas.1010662107. Epub Aug. 16, 2010.
Poller et al., A leucine-to-proline substitution causes a defective alpha 1-antichymotrypsin allele associated with familial obstructive lung disease. Genomics. Sep. 1993;17(3):740-3.
Porteus, Design and testing of zinc finger nucleases for use in mammalian cells. Methods Mol Biol. 2008;435:47-61. doi: 10.1007/978-1-59745-232-8_4.
Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.
Prashant et al., CAS9 transcriptional activators for target specificity screening and paired nickases for cooperative genome engineering. Nature Biotechnology 2013;31(9):833-8.
Prorocic et al., Zinc-finger recombinase activities in vitro. Nucleic Acids Res. Nov. 2011;39(21):9316-28. doi: 10.1093/nar/gkr652. Epub Aug. 17, 2011.
Proudfoot et al., Zinc finger recombinases with adaptable DNA sequence specificity. PLoS One. Apr. 29, 2011;6(4):e19537. doi: 10.1371/journal.pone.0019537.
Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.
Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Qi et al., Repurposing CRISPR as an RNA-guided platform for sequence-specific control of gene expression. Cell. Feb. 28, 2013;152(5):1173-83. doi: 10.1016/j.cell.2013.02.022.
Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.
Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.
Ramirez et al., Unexpected failure rates for modular assembly of engineered zinc fingers. Nat Methods. May 2008;5(5):374-5. Doi: 10.1038/nmeth0508-374.
Ran et al., Double nicking by RNA-guided CRISPR Cas9 for enhanced genome editing specificity. Cell. Sep. 12, 2013;154(6):1380-9. doi: 10.1016/j.cell.2013.08.021. Epub Aug. 29, 2013.
Ran et al., Genome engineering using the CRISPR-Cas9 system. Nat Protoc. Nov. 2013;8(11):2281-308. doi: 10.1038/nprot.2013.143. Epub Oct. 24, 2013.
Ran et al., In vivo genome editing using *Staphylococcus aureus* Cas9. Nature. Apr. 9, 2015;520(7546):186-91. doi: 10.1038/nature14299. Epub Apr. 1, 2015.
Rath et al., Fidelity of end joining in mammalian episomes and the impact of Metnase on joint processing. BMC Mol Biol. Mar. 22, 2014;15:6. doi: 10.1186/1471-2199-15-6.
Ravishankar et al., X-ray analysis of a complex of *Escherichia coli* uracil DNA glycosylase (*Ec*UDG) with a proteinaceous inhibitor. The structure elucidation of a prokaryotic UDG. Nuclei Acids Res. 26 (21): 4880-4887 (1998).
Ray et al., Homologous recombination: ends as the means. Trends Plant Sci. Oct. 2002;7(10):435-40.
Rebuzzini et al., New mammalian cellular systems to study mutations introduced at the break site by non-homologous end-joining. DNA Repair (Amst). May 2, 2005;4(5):546-55.
Rees et al., Improving the DNA specificity and applicability of base editing through protein engineering and protein delivery. Nat Commun. Jun. 6, 2017;8:15790. doi: 10.1038/ncomms15790.
Reyon et al., FLASH assembly of TALENs for high-throughput genome editing. Nat Biotechnol. May 2012;30(5):460-5. doi: 10.1038/nbt.2170.
Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.
Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.
Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.
Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.
Sadelain et al., Safe harbours for the integration of new DNA in the human genome. Nat Rev Cancer. Dec. 1, 2011;12(1):51-8. doi: 10.1038/nrc3179.
Sage et al., Proliferation of functional hair cells in vivo in the absence of the retinoblastoma protein. Science. Feb. 18, 2005;307(5712):1114-8. Epub Jan. 13, 2005.
Samal et al., Cationic polymers and their therapeutic potential. Chem Soc Rev. Nov. 7, 2012;41(21):7147-94. doi: 10.1039/c2cs35094g. Epub Aug. 10, 2012.
Sander et al., CRISPR-Cas systems for editing, regulating and targeting genomes. Nat Biotechnol. Apr. 2014;32(4):347-55. doi: 10.1038/nbt.2842. Epub Mar. 2, 2014.
Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.
Sander et al., Targeted gene disruption in somatic zebrafish cells using engineered TALENs. Nat Biotechnol. Aug. 5, 2011;29(8):697-8. doi: 10.1038/nbt.1934.
Sang, Prospects for transgenesis in the chick. Mech Dev. Sep. 2004;121(9):1179-86.
Sanjana et al., A transcription activator-like effector toolbox for genome engineering. Nat Protoc. Jan. 5, 2012;7(1):171-92. doi: 10.1038/nprot.2011.431.
Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.
Sapranauskas et al., The *Streptococcus* thermophilus CRISPR/Cas system provides immunity in *Escherichia coli*. Nucleic Acids Res. Nov. 2011;39(21):9275-82. doi: 10.1093/nar/gkr606. Epub Aug. 3, 2011.
Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.
Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.
Saudek et al., A preliminary trial of the programmable implantable medication system for insulin delivery. N Engl J Med. Aug. 31, 1989;321(9):574-9.

(56) References Cited

OTHER PUBLICATIONS

Schriefer et al., Low pressure DNA shearing: a method for random DNA sequence analysis. Nucleic Acids Res. Dec. 25, 1990;18(24):7455-6.

Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.

Schwartz et al., Post-translational enzyme activation in an animal via optimized conditional protein splicing. Nat Chem Biol. Jan. 2007;3(1):50-4. Epub Nov. 26, 2006.

Schwarze et al., In vivo protein transduction: delivery of a biologically active protein into the mouse. Science. Sep. 3, 1999;285(5433):1569-72.

Sclimenti et al., Directed evolution of a recombinase for improved genomic integration at a native human sequence. Nucleic Acids Res. Dec. 15, 2001;29(24):5044-51.

Sefton et al., Implantable pumps. Crit Rev Biomed Eng. 1987;14(3):201-40.

Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.

Sells et al., Delivery of protein into cells using polycationic liposomes. Biotechniques. Jul. 1995;19(1):72-6, 78.

Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.

Semple et al., Rational design of cationic lipids for siRNA delivery. Nat Biotechnol. Feb. 2010;28(2):172-6. doi: 10.1038/nbt.1602. Epub Jan. 17, 2010.

Seripa et al., The missing ApoE allele. Ann Hum Genet. Jul. 2007;71(Pt 4):496-500. Epub Jan. 22, 2007.

Shah et al., Inteins: nature's gift to protein chemists. Chem Sci. 2014;5(1):446-461.

Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.

Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.

Shalem et al., Genome-scale CRISPR-Cas9 knockout screening in human cells. Science. Jan. 3, 2014;343(6166):84-7. doi: 10.1126/science.1247005. Epub Dec. 12, 2013.

Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.

Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.

Shee et al., Engineered proteins detect spontaneous DNA breakage in human and bacterial cells. Elife. Oct. 29, 2013;2:e01222. doi: 10.7554/eLife.01222.

Sheridan, First CRISPR-Cas patent opens race to stake out intellectual property. Nat Biotechnol. 2014;32(7):599-601.

Sheridan, Gene therapy finds its niche. Nat Biotechnol. Feb. 2011;29(2):121-8. doi: 10.1038/nbt.1769.

Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.

Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.

Shmakov et al., Discovery and Functional Characterization of Diverse Class 2 CRISPR Cas Systems. Molecular Cell Nov. 2015;60(3):385-97.

Siebert et al., An improved PCR method for walking in uncloned genomic DNA. Nucleic Acids Res. Mar. 25, 1995;23(6):1087-8.

Simonelli et al., Base excision repair intermediates are mutagenic in mammalian cells. Nucleic Acids Res. Aug. 2, 2005;33(14):4404-11. Print 2005.

Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.

Sjoblom et al., The consensus coding sequences of human breast and colorectal cancers. Science. Oct. 13, 2006;314(5797):268-74. Epub Sep. 7, 2006.

Slaymaker et al., Rationally engineered Cas9 nucleases with improved specificity. Science. Jan. 1, 2016;351(6268):84-8. doi: 10.1126/science.aad5227. Epub Dec. 1, 2015.

Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.

Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.

Stephens et al., The landscape of cancer genes and mutational processes in breast cancer. Nature Jun. 2012;486:400-404. doi:10.1038/nature11017.

Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.

Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.

Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.

Supplementary European Search Report for Application No. EP 12845790.0, dated Oct. 12, 2015.

Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.

Swarts et al., DNA-guided DNA interference by a prokaryotic Argonaute. Nature. Mar. 13, 2014;507(7491):258-61. doi: 10.1038/nature12971. Epub Feb. 16, 2014.

Swarts et al., The evolutionary journey of Argonaute proteins. Nat Struct Mol Biol. Sep. 2014;21(9):743-53. doi: 10.1038/nsmb.2879.

Szczepek et al., Structure-based redesign of the dimerization interface reduces the toxicity of zinc-finger nucleases. Nat Biotechnol. Jul. 2007;25(7):786-93. Epub Jul. 1, 2007.

Tagalakis et al., Lack of RNA-DNA oligonucleotide (chimeraplast) mutagenic activity in mouse embryos. Mol Reprod Dev. Jun. 2005;71(2):140-4.

Tang et al., Aptazyme-embedded guide RNAs enable ligand-responsive genome editing and transcriptional activation. Nat Commun. Jun. 28, 2017;8:15939. doi: 10.1038/ncomms15939.

Tebas et al., Gene editing of CCR5 in autologous CD4 T cells of persons infected with HIV. N Engl J Med. Mar. 6, 2014;370(10):901-10. doi: 10.1056/NEJMoa1300662.

Tessarollo et al., Targeted mutation in the neurotrophin-3 gene results in loss of muscle sensory neurons. Proc Natl Acad Sci U S A. Dec. 6, 1994;91(25):11844-8.

Tesson et al., Knockout rats generated by embryo microinjection of TALENs. Nat Biotechnol. Aug. 5, 2011;29(8):695-6. doi: 10.1038/nbt.1940.

Thompson et al., Cellular uptake mechanisms and endosomal trafficking of supercharged proteins. Chem Biol. Jul. 27, 2012;19(7):831-43. doi: 10.1016/j.chembiol.2012.06.014.

Thompson et al., Engineering and identifying supercharged proteins for macromolecule delivery into mammalian cells. Methods Enzymol. 2012;503:293-319. doi: 10.1016/B978-0-12-396962-0.00012-4.

Thorpe et al., Functional correction of episomal mutations with short DNA fragments and RNA-DNA oligonucleotides. J Gene Med. Mar.-Apr. 2002;4(2):195-204.

(56) References Cited

OTHER PUBLICATIONS

Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tirumalai et al., Recognition of core-type DNA sites by lambda integrase. J Mol Biol. Jun. 12, 1998;279(3):513-27.
Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015. With Supplementary Data.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
UNIPROT Submission; UniProt, Accession No. P01011. Last modified Jun. 11, 2014, version 2. 15 pages.
UNIPROT Submission; UniProt, Accession No. P01011. Last modified Sep. 18, 2013, version 2. 15 pages.
UNIPROT Submission; UniProt, Accession No. P04264. Last modified Jun. 11, 2014, version 6. 15 pages.
UNIPROT Submission; UniProt, Accession No. P04275. Last modified Jul. 9, 2014, version 107. 29 pages.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Vagner et al., Efficiency of homologous DNA recombination varies along the Bacillus subtilis chromosome. J Bacteriol. Sep. 1988;170(9):3978-82.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Vanamee et al., Fold requires two specific DNA sites for cleavage. J Mol Biol. May 25, 2001;309(1):69-78.
Vitreschak et al., Regulation of the vitamin B12 metabolism and transport in bacteria by a conserved RNA structural element. RNA. Sep. 2003;9(9):1084-97.
Wacey et al., Disentangling the perturbational effects of amino acid substitutions in the DNA-binding domain of p53. Hum Genet. Jan. 1999;104(1):15-22.

Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wang et al., CRISPR-Cas9 Targeting of PCSK9 in Human Hepatocytes In Vivo-Brief Report. Arterioscler Thromb Vasc Biol. May 2016;36(5):783-6. doi: 10.1161/ATVBAHA.116.307227. Epub Mar. 3, 2016.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Genetic screens in human cells using the CRISPR-Cas9 system. Science. Jan. 3, 2014;343(6166):80-4. doi: 10.1126/science.1246981. Epub Dec. 12, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Weber et al., Assembly of designer TAL effectors by Golden Gate cloning. PLoS One. 2011;6(5):e19722. doi:10.1371/journal.pone.0019722. Epub May 19, 2011.
Weinberger et al., Disease-causing mutations C277R and C277Y modify gating of human C1C-1 chloride channels in myotonia congenita. J Physiol. Aug. 1, 2012;590(Pt 15):3449-64. doi: 0.1113/jphysiol.2012.232785. Epub May 28, 2012.
Wiedenheft et al., RNA-guided genetic silencing systems in bacteria and archaea. Nature. Feb. 15, 2012;482(7385):331-8. doi: 10.1038/nature10886. Review.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Wolf et al., tadA, an essential tRNA-specific adenosine deaminase from *Escherichia coli*. EMBO J. Jul. 15, 2002;21(14):3841-51.
Wolfe et al., Analysis of zinc fingers optimized via phage display: evaluating the utility of a recognition code. J Mol Biol. Feb. 5, 1999;285(5):1917-34.
Wood et al., Targeted genome editing across species using ZFNs and TALENs. Science. Jul. 15, 2011;333(6040):307. doi: 10.1126/science.1207773. Epub Jun. 23, 2011.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.

(56) References Cited

OTHER PUBLICATIONS

Xu et al., Sequence determinants of improved CRISPR sgRNA design. Genome Res. Aug. 2015;25(8):1147-57. doi: 10.1101/gr.191452.115. Epub Jun. 10, 2015.
Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.
Yamamoto et al., Virological and immunological bases for HIV-1 vaccine design. Uirusu 2007;57(2):133-139. https://doi.org/10.2222/jsv.57.133.
Yamano et al., Crystal Structure of Cpf1 in Complex with Guide RNA and Target DNA. Cell May 2016;165(4)949-62.
Yang et al., Engineering and optimising deaminase fusions for genome editing. Nat Commun. Nov. 2, 2016;7:13330. doi: 10.1038/ncomms13330.
Yang et al., Genome editing with targeted deaminases. BioRxiv. Preprint. First posted online Jul. 28, 2016.
Yang et al., New CRISPR-Cas systems discovered. Cell Res. Mar. 2017;27(3):313-314. doi: 10.1038/cr.2017.21. Epub Feb. 21, 2017.
Yang et al., PAM-dependent Target DNA Recognition and Cleavage by C2C1 CRISPR-Cas endonuclease. Cell Dec. 2016;167(7):1814-28.
Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.
Yazaki et al., Hereditary systemic amyloidosis associated with a new apolipoprotein AII stop codon mutation Stop78Arg. Kidney Int. Jul. 2003;64(1):11-6.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Yuan et al., Tetrameric structure of a serine integrase catalytic domain. Structure. Aug. 6, 2008;16(8):1275-86. doi: 10.1016/j.str.2008.04.018.
Yuen et al., Control of transcription factor activity and osteoblast differentiation in mammalian cells using an evolved small-molecule-dependent intein. J Am Chem Soc. Jul. 12, 2006;128(27):8939-46.
Zelphati et al., Intracellular delivery of proteins with a new lipid-mediated delivery system. J Biol Chem. Sep. 14, 2001;276(37):35103-10. Epub Jul. 10, 2001.
Zetsche et al., A split-Cas9 architecture for inducible genome editing and transcription modulation. Nat Biotechnol. Feb. 2015;33(2):139-42. doi: 10.1038/nbt.3149.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zhang et al., Comparison of non-canonical PAMs for CRISPR/Cas9-mediated DNA cleavage in human cells. Sci Rep. Jun. 2014;4:5405.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.
Zhang et al., Programmable base editing of zebrafish genome using a modified CRISPR-Cas9 system. Nat Commun. Jul. 25, 2017;8(1):118. doi: 10.1038/s41467-017-00175-6.
Zhang et al., Stabilized plasmid-lipid particles for regional gene therapy: formulation and transfection properties. Gene Ther. Aug. 1999;6(8):1438-47.
Zheng et al., DNA editing in DNA/RNA hybrids by adenosine deaminases that act on RNA. Nucleic Acids Res. Apr. 7, 2017;45(6):3369-3377. doi: 10.1093/nar/gkx050.
Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.
Zorko et al., Cell-penetrating peptides: mechanism and kinetics of cargo delivery. Adv Drug Deliv Rev. Feb. 28, 2005;57(4):529-45. Epub Jan. 22, 2005.
Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.
Zuris et al., Cationic lipid-mediated delivery of proteins enables efficient protein-based genome editing in vitro and in vivo. Nat Biotechnol. 2015;33:73-80.
Burke et al., RNA Aptamers to the Adenosine Moiety of S-adenosyl Methionine: Structural Inferences From Variations on a Theme and the Reproducibility of SELEX. Nucleic Acids Res. May 15, 1997;25(10):2020-4. doi: 10.1093/nar/25.10.2020.
Eiler et al., Structural Basis for the Fast Self-Cleavage Reaction Catalyzed by the Twister Ribozyme. Proc Natl Acad Sci U S A. Sep. 9, 2014;111(36):13028-33. doi: 10.1073/pnas.1414571111. Epub Aug. 25, 2014.
Pelletti et al., Twister Ribozymes as Highly Versatile Expression Platforms for Artificial Riboswitches. Nat Commun. Sep. 27, 2016;7:12834. doi: 10.1038/ncomms12834.
Genbank Submission; NIH/NCBI, Accession No. NM_174936. Guo et al., Oct 28, 2015. 6 pages.
Harrington et al., Recent developments and current status of gene therapy using viral vectors in the United Kingdom. BMJ. 2004;329(7470):839?842. doi:10.1136/bmj.329.7470.839.
Hirano et al., Structural Basis for the Altered PAM Specificities of Engineered CRISPR-Cas9. Mol Cell. Mar. 17, 2016;61(6):886-94. doi: 10.1016/j.molcel.2016.02.018.
Horvath et al., Diversity, Activity, and Evolution of CRISPR Loci in *Streptococcus* Thermophilus. J Bacteriol. Feb. 2008;190(4):1401-12. doi: 10.1128/JB.01415-07. Epub Dec. 7, 2007.
Jiang et al., Structural Biology. A Cas9-guide RNA Complex Preorganized for Target DNA Recognition. Science. Jun. 26, 2015;348(6242):1477-81. doi: 10.1126/science.aab1452.
Kobori et al., Deep Sequencing Analysis of Aptazyme Variants Based on a Pistol Ribozyme. ACS Synth Biol. Jul. 21, 2017;6(7):1283-1288. doi: 10.1021/acssynbio.7b00057. Epub Apr. 14, 2017.
Koonin et al., Diversity, classification and evolution of CRISPR-Cas systems. Curr Opin Microbiol. 2017;37:67?78. doi:10.1016/j.mib.2017.05.008.
Lilley, D.M. The Varkud Satellite Ribozyme. RNA. Feb. 2004;10(2):151-8.doi: 10.1261/rna.5217104.
Liu et al., Functional Nucleic Acid Sensors. Chem Rev. May 2009;109(5):1948-98. doi: 10.1021/cr030183i.
Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.
Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.
Mir et al., Two Active Site Divalent Ions in the Crystal Structure of the Hammerhead Ribozyme Bound to a Transition State Analogue. Biochemistry. Feb. 2, 2016;55(4):633-6. doi: 10.1021/acs.biochem.5b01139. Epub Jan. 19, 2016.
Ni et al., A PCSK9-binding antibody that structurally mimics the egf(a) domain of LDL-receptor reduces LDL cholesterol in vivo. J Lipid Res. 2011;52:76-86.
Nishikura, Functions and regulation of RNA editing by ADAR deaminases. Annu Rev Biochem. 2010;79:321-349. doi:10.1146/annurev-biochem-060208-105251.
Nishimasu et al., Crystal Structure of *Staphylococcus aureus* Cas9. Cell. Aug. 27, 2015;162(5):1113-26. doi: 10.1016/j.cell.2015.08.007.
Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.
Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.

(56) References Cited

OTHER PUBLICATIONS

Oakes et al., Protein engineering of Cas9 for enhanced function. Methods Enzymol. 2014;546:491-511.
Pospíšilová et al., Hydrolytic cleavage of N6-substituted adenine derivatives by eukaryotic adenine and adenosine deaminases. Biosci Rep. 2008;28(6):335-347. doi:10.1042/BSR20080081.
Ren et al., In-line Alignment and $Mg^2$ Coordination at the Cleavage Site of the env22 Twister Ribozyme. Nat Commun. Nov. 20, 2014;5:5534. doi: 10.1038/ncomms6534.
Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.
Sasidharan et al., The selection of acceptable protein mutations. PNAS; Jun. 12, 2007;104(24):10080-5. www.pnas.org/cgi/doi/10.1073.pnas.0703737104.
Wang et al., Enhanced base editing by co-expression of free uracil DNA glycosylase inhibitor. Cell Res. Oct. 2017;27(1):1289-92. doi: 10.1038/cr.2017.111. Epub Aug. 29, 2017.
Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.
Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.
Wilson et al., In Vitro Selection of Functional Nucleic Acids. Annu Rev Biochem. 1999;68:611-47. doi: 10.1146/annurev.biochem.68.1.611.
Wilson et al., Assessing annotation transfer for genomics: quantifying the relations between protein sequence, structure and function through traditional and probabilistic scores. J Mol Biol 2000;297:233-49.
Zhang et al., Ribozymes and Riboswitches: Modulation of RNA Function by Small Molecules. Biochemistry. Nov. 2, 2010;49(43):9123-31. doi: 10.1021/bi1012645.
Zhong et al., Rational Design of Aptazyme Riboswitches for Efficient Control of Gene Expression in Mammalian Cells. Elife. Nov. 2, 2016;5:e18858. doi: 10.7554/eLife.18858.
Search Report and Written Opinion for SG 11201900907Y, dated Jul. 20, 2020.
U.S. Appl. No. 14/234,031, filed Mar. 24, 2014, Liu et al.
U.S. Appl. No. 14/320,271, filed Jun. 30, 2014, Liu et al.
U.S. Appl. No. 16/441,751, filed Jun. 14, 2019, Liu et al.
U.S. Appl. No. 14/320,519, filed Jun. 30, 2014, Liu et al.
U.S. Appl. No. 14/913,458, filed Feb. 22, 2016, Liu et al.
U.S. Appl. No. 16/266,937, filed Feb. 4, 2019, Liu et al.
U.S. Appl. No. 14/320,370, filed Jun. 30, 2014, Liu et al.
U.S. Appl. No. 14/320,413, filed Jun. 30, 2014, Liu et al.
U.S. Appl. No. 14/874,123, filed Oct. 2, 2015, Liu et al.
U.S. Appl. No. 14/911,117, filed Feb. 9, 2016, Liu et al.
U.S. Appl. No. 14/462,163, filed Aug. 18, 2014, Liu et al.
U.S. Appl. No. 14/462,189, filed Aug. 18, 2014, Liu et al.
U.S. Appl. No. 14/916,679, filed Mar. 4, 2016, Liu et al.
U.S. Appl. No. 14/890,639, filed Apr. 28, 2020, Liu et al.
U.S. Appl. No. 14/320,498, filed Jun. 30, 2014, Liu et al.
U.S. Appl. No. 14/320,467, filed Jun. 30, 2014, Liu et al.
U.S. Appl. No. 14/916,681, filed Mar. 4, 2016, Liu et al.
U.S. Appl. No. 14/326,329, filed Jul. 8, 2014, Liu et al.
U.S. Appl. No. 14/326,340, filed Jul. 8, 2014, Liu et al.
U.S. Appl. No. 14/326,361, filed Jul. 8, 2014, Liu et al.
U.S. Appl. No. 14/916,683, filed Mar. 4, 2016, Liu et al.
U.S. Appl. No. 16/796,323, filed Feb. 20, 2020, Liu et al.
U.S. Appl. No. 14/325,815, filed Jul. 8, 2014, Liu et al.
U.S. Appl. No. 14/326,109, filed Jul. 8, 2014, Liu et al.
U.S. Appl. No. 14/326,140, filed Jul. 8, 2014, Liu et al.
U.S. Appl. No. 14/326,269, filed Jul. 8, 2014, Liu et al.
U.S. Appl. No. 14/326,290, filed Jul. 8, 2014, Liu et al.
U.S. Appl. No. 14/326,318, filed Jul. 8, 2014, Liu et al.
U.S. Appl. No. 14/326,303, filed Jul. 8, 2014, Liu et al.
U.S. Appl. No. 15/103,608, filed Jun. 10, 2016, Liu et al.
U.S. Appl. No. 16/374,634, filed Apr. 30, 2019, Liu et al.
U.S. Appl. No. 15/329,925, filed Jan. 27, 2017, Liu et al.
U.S. Appl. No. 16/132,276, filed Sep. 14, 2018, Liu et al.
U.S. Appl. No. 16/888,646, filed May 29, 2020, Liu et al.
U.S. Appl. No. 14/529,010, filed Oct. 30, 2014, Liu et al.
U.S. Appl. No. 15/958,721, filed Apr. 20, 2018, Liu et al.
U.S. Appl. No. 15/331,852, filed Oct. 22, 2016, Liu et al.
U.S. Appl. No. 15/960,171, filed Apr. 23, 2018, Liu et al.
U.S. Appl. No. 15/770,076, filed Apr. 20, 2018, Liu et al.
U.S. Appl. No. 16/327,744, filed Feb. 22, 2019, Maianti et al.
U.S. Appl. No. 15/852,891, filed Dec. 22, 2017, Maianti et al.
U.S. Appl. No. 16/926,436, filed Jul. 10, 2020, Maianti et al.
U.S. Appl. No. 15/852,526, filed Dec. 22, 2017, Maianti et al.
U.S. Appl. No. 16/492,534, filed Sep. 9, 2019, Liu et al.
U.S. Appl. No. 16/324,476, filed Feb. 8, 2019, Liu et al.
U.S. Appl. No. 15/791,085, filed Oct. 23, 2017, Liu et al.
U.S. Appl. No. 16/492,548, filed Sep. 9, 2019, Liu et al.
U.S. Appl. No. 15/784,033, filed Oct. 13, 2017, Liu et al.
U.S. Appl. No. 16/492,553, filed Sep. 9, 2019, Liu et al.
U.S. Appl. No. 15/934,945, filed Mar. 23, 2018, Liu et al.
U.S. Appl. No. 16/643,376, filed Feb. 28, 2020, Liu et al.
U.S. Appl. No. 16/612,988, filed Nov. 12, 2019, Liu et al.
U.S. Appl. No. 16/634,405, filed Jan. 27, 2020, Liu et al.
U.S. Appl. No. 16/756,432, filed Apr. 15, 2020, Liu et al.
U.S. Appl. No. 16/772,747, filed Jun. 12, 2020, Shen et al.
SG 11201900907Y, Jul. 20, 2020, Search Report and Written Opinion.

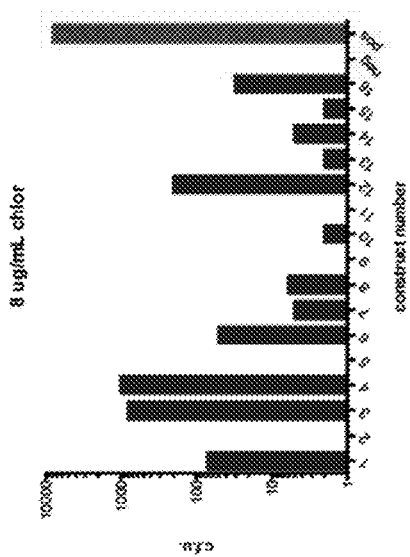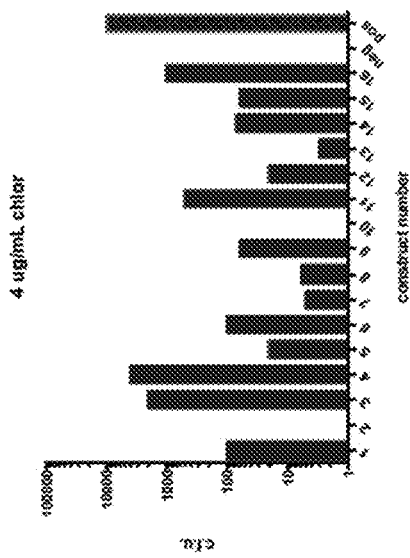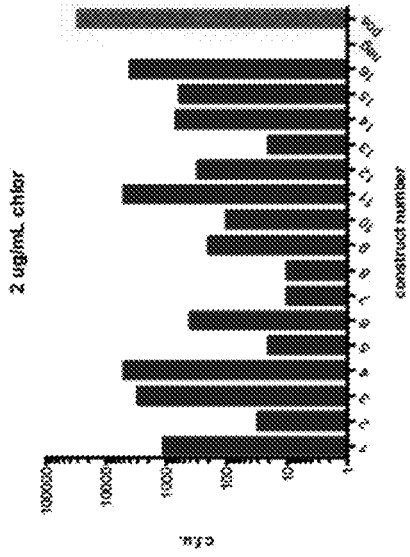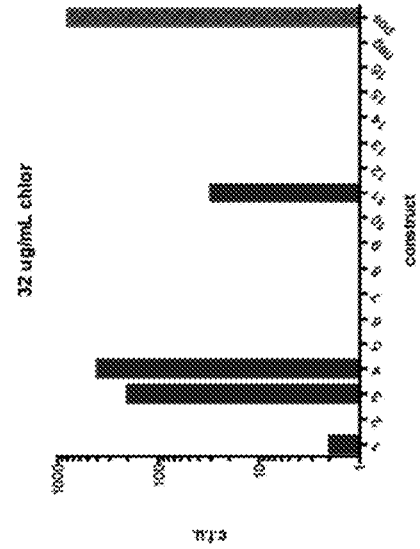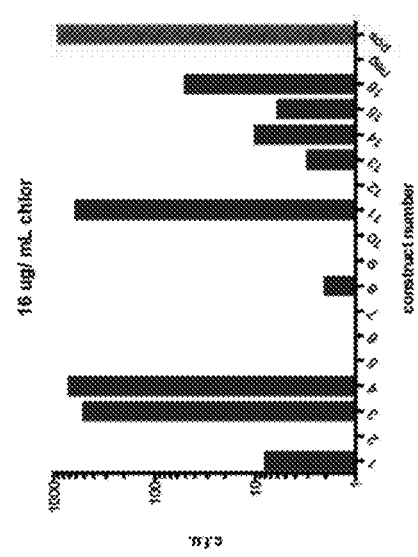
FIGURE 12

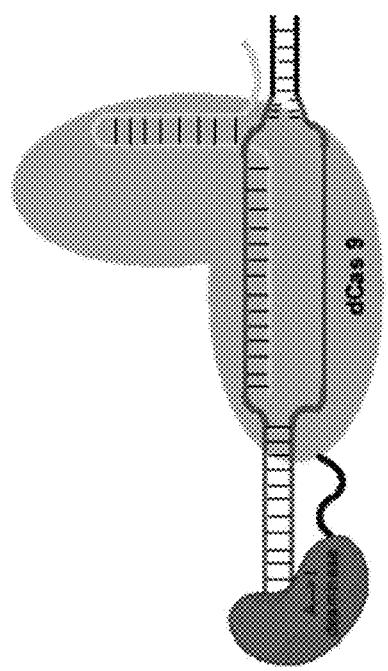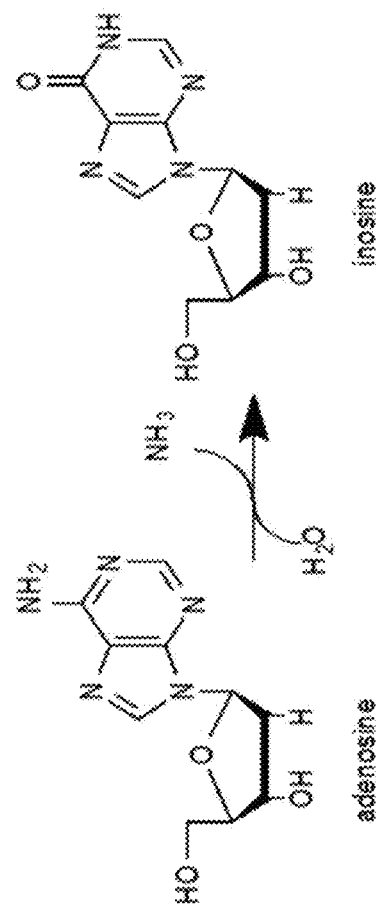
FIGURE 15

| position: | 8 | 26 | 61 | 68 | 70 | 106 | 107 | 108 | 109 | 127 | 147 | 152 | 154 | 155 | 161 | 163 | 166 | wt residue |
|---|---|---|---|---|---|---|---|---|---|---|---|---|---|---|---|---|---|---|
| | His | Arg | Met | Leu | Met | Ala | Arg | Asp | Ala | Asn | Asp | Ala | Gln | E | Lys | Gln | Thr | |
| 1pNMG-149 | Tyr | | | | | | | | | | | | | | | | | |
| 2pNMG-150 | Tyr | | Ile | | Val | | | Asn | | Ser | Tyr | Cys | His | Gly | | | | |
| 3pNMG-151 | Tyr | | | | | | | Asn | | Ser | | | Arg | Val | | His | Pro | |
| 4pNMG-152 | Tyr | | | | | | | Asn | | Ser | | | | Asp | Gln | | | |
| 5pNMG-153 | Trp | | | Gln | | Thr | | Asn | | Ser | Tyr | | | Val | | | | |
| 6pNMG-154 | Tyr | | | | | | | Asn | Thr | Ser | | | | Gly | | | | |

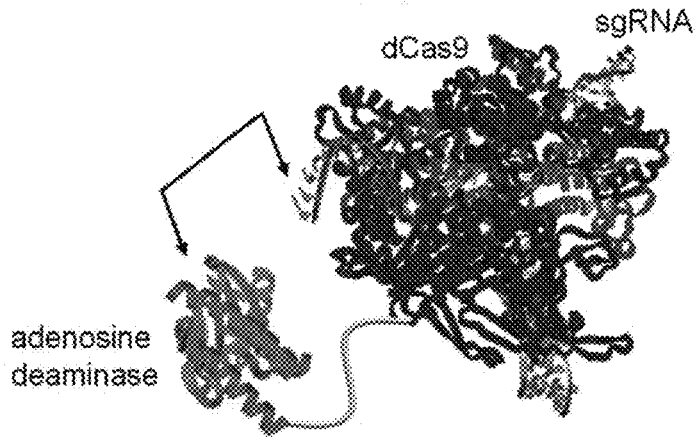

FIGURE 47

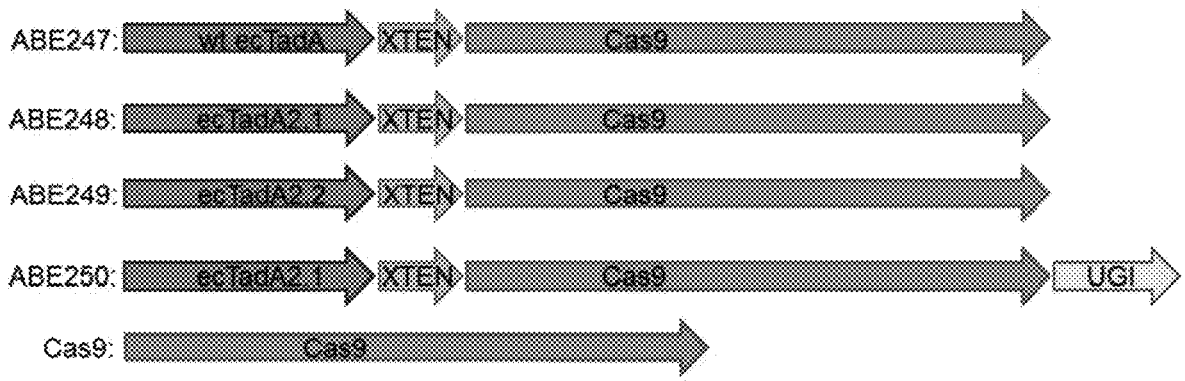

FIGURE 48

|        | EMX1  | FANCF | HEK2  | HEK3  | HEK4  | RNF2  |
|--------|-------|-------|-------|-------|-------|-------|
| wtCas9 | 35.4% | 37.0% | 32.9% | 56.8% | 23.8% | 33.8% |
| ABE247 | 25.5% | 30.2% | 45.7% | 76.3% | 36.5% | 26.8% |
| ABE248 | 24.8% | 26.6% | 39.8% | 64.2% | 35.1% | 26.5% |
| ABE249 | 30.2% | 28.6% | 42.0% | 66.7% | 40.0% | 27.1% |
| ABE250 | 25.0% | 25.2% | 31.3% | 56.3% | 36.4% | 25.2% |

FIGURE 49

```
               protospacer                    PAM
               ─────────────────────────     ───
EMX1:          GA₂GTCCGA₆GCAGAAGAAGAA   GGG
FANCF:         GGA₃A₄TCCCTTCTGCAGCACC   TGG
HEK293 site 2: GA₂A₃CA₅CA₇A₈A₉GCATAGACTGC GGG
HEK293 site 3: GGCCCA₆GA₈CTGAGCACGTGAT GG
HEK293 site 4: GGCA₄CTGCGGCTGGAGGTCC   GGG
RNF2:          GTCA₄TCTTA₉GTCATTACCT   GAGG
```

HEK293 site 2:  GA₂A₃CA₅CA₇A₈A₉GCATAGACTGCGGG  (see high editing at A-5)

EMX1:  GA₂GTCCGA₈GCAGAAGAAGAAGGG  (see no editing)

HEK293 site 3:  GGCCCA₆GA₈CTGAGCACGTGATGG  (see low editing)

HEK293 site 2:  GA₂A₃CA₅CA₇A₈A₉GCATAGACTGCGGG

RNF2 multi-A:   A₁GA₃A₄A₅A₆A₇CA₉A₁₀TTTTAGTATTTGG

HEK3 multi-A:   GCA₃GA₅A₆A₇TA₉GA₁₁CTAATTGCATGG

FIGURE 59

| HEK2 | | A₂ | A₃ | A₅ | A₇ | A₆ | A₈ |
|---|---|---|---|---|---|---|---|
| untreated | A | 100 | 100 | 100 | 100 | 100 | 100 |
| | C | 0 | 0 | 0 | 0 | 0 | 0 |
| | G | 0 | 0 | 0 | 0 | 0 | 0 |
| | T | 0 | 0 | 0 | 0 | 0 | 0 |
| XTEN | A | 100 | 99.8 | 90.6 | 100 | 100 | 100 |
| | C | 0 | 0 | 0 | 0 | 0 | 0 |
| | G | 0 | 0.2 | 9.4 | 0 | 0 | 0 |
| | T | 0 | 0 | 0 | 0 | 0 | 0 |
| GGS | A | 100 | 99.9 | 87.7 | 100 | 100 | 100 |
| | C | 0 | 0 | 0 | 0 | 0 | 0 |
| | G | 0 | 0.1 | 12.3 | 0 | 0 | 0 |
| | T | 0 | 0 | 0 | 0 | 0 | 0 |
| (GGS)₂XTEN(GGS)₂ | A | 100 | 99.9 | 77.6 | 100 | 100 | 100 |
| | C | 0 | 0 | 0 | 0 | 0 | 0 |
| | G | 0 | 0.1 | 22.4 | 0 | 0 | 0 |
| | T | 0 | 0 | 0 | 0 | 0 | 0 |

FIGURE 60

| | | EMX1 A₂ | A₆ | FANCF A₃ | A₄ | HEK3 A₅ | A₆ | HEK4 A₄ | RNF2 A₄ | A₆ |
|---|---|---|---|---|---|---|---|---|---|---|
| untreated | A | 100.0 | 100.0 | 100.0 | 100.0 | 100.0 | 100.0 | 100 | 100.0 | 100.0 |
| | C | 0.0 | 0.0 | 0.0 | 0.0 | 0.0 | 0.0 | 0 | 0.0 | 0.0 |
| | G | 0.0 | 0.0 | 0.0 | 0.0 | 0.0 | 0.0 | 0 | 0.0 | 0.0 |
| | T | 0.0 | 0.0 | 0.0 | 0.0 | 0.0 | 0.0 | 0 | 0.0 | 0.0 |
| XTEN (pNMG-164; pCMV_ecTadA_XTEN_Cas9n_GGS_N.S D10BN_D147Y_E155V) | A | 100.0 | 100.0 | 100.0 | 100.0 | 99.8 | 99.4 | 99.7 | 99.9 | 99.9 |
| | C | 0.0 | 0.0 | 0.0 | 0.0 | 0.0 | 0.0 | 0.0 | 0.0 | 0.0 |
| | G | 0.0 | 0.0 | 0.0 | 0.0 | 0.2 | 0.6 | 0.3 | 0.0 | 0.1 |
| | T | 0.0 | 0.0 | 0.0 | 0.0 | 0.0 | 0.0 | 0.0 | 0.0 | 0.0 |
| GGS (pNMG-162; pCMV_ecTadA_GGS_Cas9n_GGS_N.S D10BN_D147Y_E155V) | A | 100.0 | 100.0 | 100.0 | 99.8 | 99.7 | 99.8 | 99.5 | 99.9 | 100.0 |
| | C | 0.0 | 0.0 | 0.0 | 0.0 | 0.0 | 0.0 | 0.0 | 0.0 | 0.0 |
| | G | 0.0 | 0.0 | 0.0 | 0.2 | 0.2 | 0.2 | 0.4 | 0.0 | 0.0 |
| | T | 0.0 | 0.0 | 0.0 | 0.0 | 0.0 | 0.0 | 0.0 | 0.0 | 0.0 |
| (GGS)₂XTEN(GGS)₂ (pNMG-183; pCMV_ecTadA_(GGS)2_XTEN_(GGS)2_Cas9n_GGS_N.S D10BN_D147Y_E155V) | A | 100.0 | 99.8 | 100.0 | 99.9 | 99.8 | 99.0 | 99.4 | 99.9 | 99.9 |
| | C | 0.0 | 0.0 | 0.0 | 0.0 | 0.0 | 0.0 | 0.0 | 0.0 | 0.0 |
| | G | 0.0 | 0.2 | 0.0 | 0.1 | 0.2 | 1.0 | 0.6 | 0.1 | 0.1 |
| | T | 0.0 | 0.0 | 0.0 | 0.0 | 0.0 | 0.0 | 0.0 | 0.0 | 0.0 |

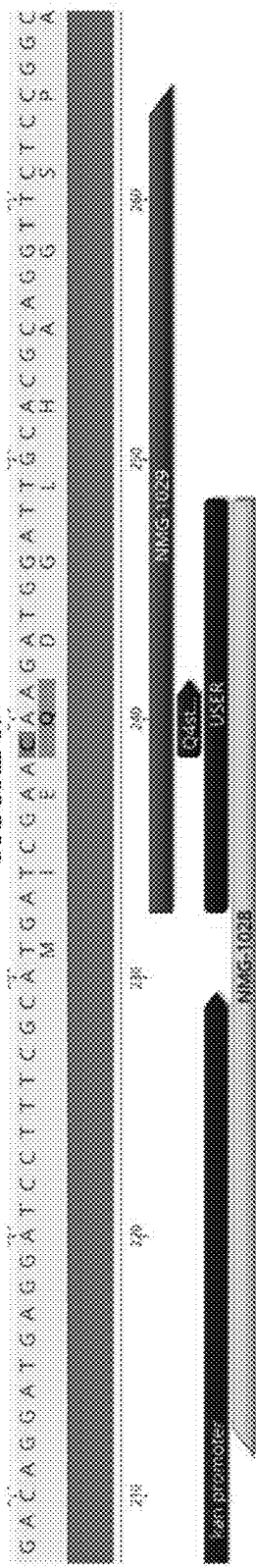
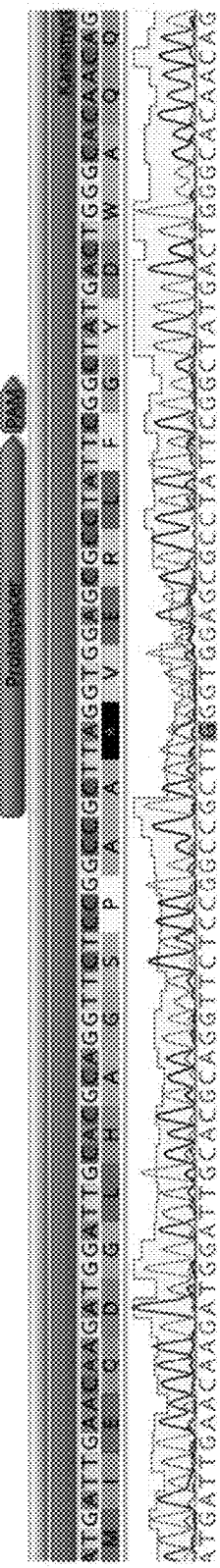
FIGURE 69
FIGURE 70

FIGURE 71

HEK293 site 2: GA(A)₃CA(A)₃CA(A)₃(A)₃GCATAGACTGCGGG
(showing as T to C)

FANCF: GGA₃A₄TCCCTTCTGCAGCACCTGG

Run # 2:

FIGURE 75

| | parental | | | | out | | | | out | |
|---|---|---|---|---|---|---|---|---|---|---|
| 142 (pCMV_ec TadA_XTE N_Cas9n_ GGS_NLS; wild-type) | $A_3$ | $A_4$ | | 142 (pCMV_ec TadA_XTE N_Cas9n_ GGS_NLS; wild-type) | $A_3$ | $A_4$ | | 142 (pCMV_ec TadA_XTE N_Cas9n_ GGS_NLS; wild-type) | $A_3$ | $A_4$ |
| A | 100.0 | 100.0 | | A | 100.0 | 100.0 | | A | 100.0 | 100.0 |
| C | 0.0 | 0.0 | | C | 0.0 | 0.0 | | C | 0.0 | 0.0 |
| G | 0.0 | 0.0 | | G | 0.0 | 0.0 | | G | 0.0 | 0.0 |
| T | 0.0 | 0.0 | | T | 0.0 | 0.0 | | T | 0.0 | 0.0 |
| 177 (pCMV_ec TadA_XTE N_Cas9n_ GGS_NLS; A106V_D108N_D147Y_E155V) | | | | 177 (pCMV_ec TadA_XTE N_Cas9n_ GGS_NLS; A106V_D108N_D147Y_E155V) | | | | 177 (pCMV_ec TadA_XTE N_Cas9n_ GGS_NLS; A106V_D108N_D147Y_E155V) | | |
| A | 100.0 | 99.7 | | A | 100.0 | 99.8 | | A | 99.9 | 99.6 |
| C | 0.0 | 0.0 | | C | 0.0 | 0.0 | | C | 0.0 | 0.0 |
| G | 0.0 | 0.3 | | G | 0.0 | 0.2 | | G | 0.1 | 0.2 |
| T | 0.0 | 0.0 | | T | 0.0 | 0.0 | | T | 0.0 | 0.0 |
| 179 (pCMV_ec TadA_XTE N_Cas9n_ GGS_AAG* (E125Q)_GGS_NLS; A106V_D108N_D147Y_E155V) | | | | 179 (pCMV_ec TadA_XTE N_Cas9n_ GGS_AAG* (E125Q)_GGS_NLS; A106V_D108N_D147Y_E155V) | | | | 179 (pCMV_ec TadA_XTE N_Cas9n_ GGS_AAG* (E125Q)_GGS_NLS; A106V_D108N_D147Y_E155V) | | |
| A | 100.0 | 100.0 | | A | 100.0 | 99.8 | | A | 100.0 | 99.9 |
| C | 0.0 | 0.0 | | C | 0.0 | 0.0 | | C | 0.0 | 0.0 |
| G | 0.0 | 0.0 | | G | 0.0 | 0.1 | | G | 0.0 | 0.0 |
| T | 0.0 | 0.0 | | T | 0.0 | 0.0 | | T | 0.0 | 0.0 |
| 180 (pCMV_ec TadA_XTE N_Cas9n_ GGS_UGI_GGS_NLS; A106V_D108N_D147Y_E155V) | | | | 180 (pCMV_ec TadA_XTE N_Cas9n_ GGS_UGI_GGS_NLS; A106V_D108N_D147Y_E155V) | | | | 180 (pCMV_ec TadA_XTE N_Cas9n_ GGS_UGI_GGS_NLS; A106V_D108N_D147Y_E155V) | | |
| A | 100.0 | 99.8 | | A | 100.0 | 100.0 | | A | 100.0 | 99.9 |
| C | 0.0 | 0.0 | | C | 0.0 | 0.0 | | C | 0.0 | 0.0 |
| G | 0.0 | 0.2 | | G | 0.0 | 0.0 | | G | 0.0 | 0.1 |
| T | 0.0 | 0.0 | | T | 0.0 | 0.0 | | T | 0.0 | 0.0 |

| HEK2 | | $A_2$ | $A_3$ | $A_5$ | $A_7$ | $A_8$ | $A_9$ |
|---|---|---|---|---|---|---|---|
| 177 (pCMV_ecTadA_XTEN_Cas9n_GGS_NLS: A106V_D108N_D147Y_E155V) | A | 100.0 | 99.7 | 74.1 | 100.0 | 99.9 | 100.0 |
| | C | 0.0 | 0.0 | 0.0 | 0.0 | 0.0 | 0.0 |
| | G | 0.0 | 0.3 | 25.9 | 0.0 | 0.1 | 0.0 |
| | T | 0.0 | 0.0 | 0.0 | 0.0 | 0.0 | 0.0 |
| 179 (pCMV_ecTadA_XTEN_Cas9n_GGS_AAG*(E125Q)_GGS_NLS: A106V_D108N_D147Y_E155V) | A | 100.0 | 99.6 | 69.8 | 99.9 | 99.9 | 100.0 |
| | C | 0.0 | 0.0 | 0.0 | 0.0 | 0.0 | 0.0 |
| | G | 0.0 | 0.4 | 30.2 | 0.1 | 0.1 | 0.0 |
| | T | 0.0 | 0.0 | 0.0 | 0.0 | 0.0 | 0.0 |
| 235 (pCMV_ecTadA_XTEN_Cas9n_XTEN_AAG*(E125A)_GGS_NLS: A106V_D108N_D147Y_E155V) | A | 100.0 | 99.7 | 77.4 | 99.9 | 99.9 | 100.0 |
| | C | 0.0 | 0.0 | 0.0 | 0.0 | 0.0 | 0.0 |
| | G | 0.0 | 0.3 | 22.6 | 0.1 | 0.1 | 0.0 |
| | T | 0.0 | 0.0 | 0.0 | 0.0 | 0.0 | 0.0 |
| 236 (pCMV_ecTadA_XTEN_Cas9n_XTEN_AAG*(E125Q)_GGS_NLS: A106V_D108N_D147Y_E155V) | A | 100.0 | 99.9 | 94.4 | 100.0 | 100.0 | 100.0 |
| | C | 0.0 | 0.0 | 0.0 | 0.0 | 0.0 | 0.0 |
| | G | 0.0 | 0.1 | 5.6 | 0.0 | 0.0 | 0.0 |
| | T | 0.0 | 0.0 | 0.0 | 0.0 | 0.0 | 0.0 |
| 237 (pCMV_ecTadA_XTEN_Cas9n_XTEN_AAG*(wt)_GGS_NLS: A106V_D108N_D147Y_E155V) | A | 100.0 | 99.5 | 62.6 | 99.9 | 99.9 | 100.0 |
| | C | 0.0 | 0.0 | 0.1 | 0.0 | 0.0 | 0.0 |
| | G | 0.0 | 0.5 | 37.1 | 0.1 | 0.1 | 0.0 |
| | T | 0.0 | 0.0 | 0.0 | 0.0 | 0.0 | 0.0 |

| HEK2 | | A₂ | A₃ | A₅ | A₇ | A₈ | A₉ |
|---|---|---|---|---|---|---|---|
| 177 (pCMV_ecTadA_XTEN_Cas9n_GGS_NLS; A106V_D108N_D147Y_E155V) | A | 100.0 | 99.7 | 74.1 | 100.0 | 99.9 | 100.0 |
| | C | 0.0 | 0.0 | 0.0 | 0.0 | 0.0 | 0.0 |
| | G | 0.0 | 0.3 | 25.9 | 0.0 | 0.1 | 0.0 |
| | T | 0.0 | 0.0 | 0.0 | 0.0 | 0.0 | 0.0 |
| 238 (pCMV_AAG*(E125A)_XTEN_ecTadA_XTEN_Cas9n_GGS_NLS; A106V_D108N_D147Y_E15 | A | 100.0 | 99.9 | 74.8 | 99.9 | 100.0 | 100.0 |
| | C | 0.0 | 0.0 | 0.0 | 0.0 | 0.0 | 0.0 |
| | G | 0.0 | 0.1 | 25.2 | 0.1 | 0.0 | 0.0 |
| | T | 0.0 | 0.0 | 0.0 | 0.0 | 0.0 | 0.0 |
| 239 (pCMV_AAG*(wt)_XTEN_ecTadA_XTEN_Cas9n_GGS_NLS; A106V_D108N_D147Y_E15 | A | 100.0 | 99.8 | 69.0 | 99.9 | 99.9 | 100.0 |
| | C | 0.0 | 0.0 | 0.1 | 0.0 | 0.0 | 0.0 |
| | G | 0.0 | 0.2 | 30.9 | 0.1 | 0.1 | 0.0 |
| | T | 0.0 | 0.0 | 0.0 | 0.0 | 0.0 | 0.0 |

FIGURE 86
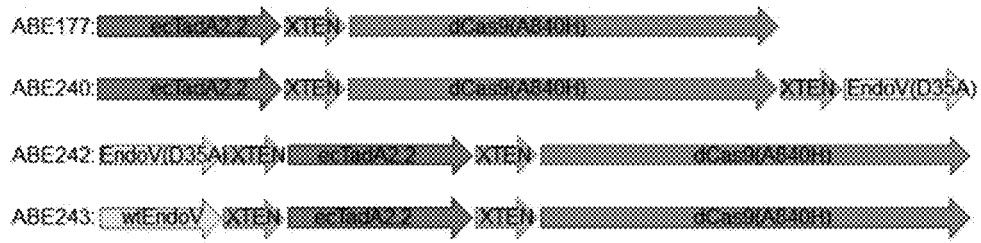
FIGURE 87
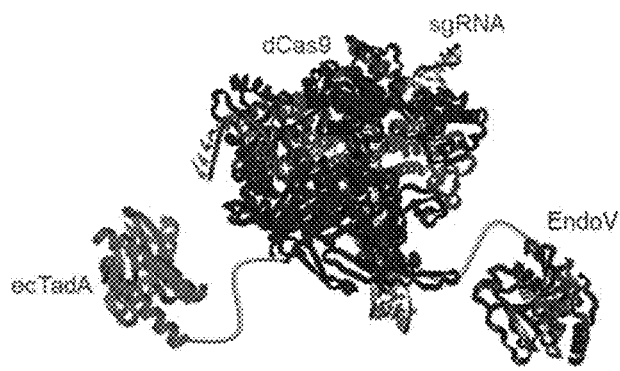
FIGURE 88
| HEK2 | | $A_2$ | $A_3$ | $A_5$ | $A_7$ | $A_8$ | $A_9$ |
|---|---|---|---|---|---|---|---|
| 177 (pCMV_ecTadA_ XTEN_Cas9n_G GS_NLS; A106V_D108N_ D147Y_E155V) | A | 100.0 | 99.7 | 74.1 | 100.0 | 99.9 | 100.0 |
| | C | 0.0 | 0.0 | 0.0 | 0.0 | 0.0 | 0.0 |
| | G | 0.0 | 0.3 | 25.9 | 0.0 | 0.1 | 0.0 |
| | T | 0.0 | 0.0 | 0.0 | 0.0 | 0.0 | 0.0 |
| 240 (pCMV_ecTadA_ XTEN_Cas9n_XT EN_EndoV*(D35 A)_GGS_NLS; A106V_D108N_ D147Y_E155V) | A | 100.0 | 99.7 | 64.6 | 99.9 | 99.9 | 99.9 |
| | C | 0.0 | 0.0 | 0.0 | 0.0 | 0.0 | 0.0 |
| | G | 0.0 | 0.3 | 35.2 | 0.1 | 0.1 | 0.1 |
| | T | 0.0 | 0.0 | 0.0 | 0.0 | 0.0 | 0.0 |
| 242 (pCMV_EndoV*( D35A)_XTEN_ec TadA_XTEN_Cas 9n_GGS_NLS; A106V_D108N_ D147Y_E155V) | A | 100.0 | 99.9 | 53.6 | 100.0 | 99.9 | 100.0 |
| | C | 0.0 | 0.0 | 0.0 | 0.0 | 0.0 | 0.0 |
| | G | 0.0 | 0.1 | 46.3 | 0.0 | 0.1 | 0.0 |
| | T | 0.0 | 0.0 | 0.0 | 0.0 | 0.0 | 0.0 |
| 243 (pCMV_EndoV*( wt)_XTEN_ecTad A_XTEN_Cas9n_ GGS_NLS; A106V_D108N_ D147Y_E155V) | A | 100.0 | 99.9 | 67.9 | 99.9 | 99.9 | 100.0 |
| | C | 0.0 | 0.0 | 0.0 | 0.0 | 0.1 | 0.0 |
| | G | 0.0 | 0.1 | 32.0 | 0.0 | 0.0 | 0.0 |
| | T | 0.0 | 0.0 | 0.0 | 0.0 | 0.0 | 0.0 |

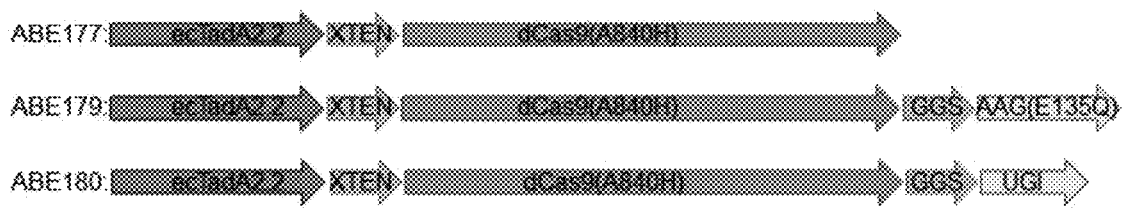

| wt res | S2 | H8 | I49 | L84 | A106 | D108 | H123 | N127 | D147 | E155 | I156 | K160 |
|---|---|---|---|---|---|---|---|---|---|---|---|---|
| clone 1 | Ala | | | Phe | Val | Arg | Tyr | | Tyr | Val | Phe | |
| clone 2 | | Phe | | Val | Val | Arg | | | Tyr | Val | | |
| clone 3 | | Tyr | | Thr | | Arg | | Ser | Asp | Glu | | Ser |

| HEK2 | G | A | A | C | A | C | A | A | A | G |
|---|---|---|---|---|---|---|---|---|---|---|
| 339 | | 0.1% | 5.0% | | 58.6% | | 1.6% | 1.9% | 0.9% | |
| 340 | | 0.1% | 2.6% | | 61.2% | | 0.5% | 1.1% | 0.6% | |
| 341 | | 0.1% | 6.0% | | 57.2% | | 1.7% | 1.6% | 1.1% | |

| HEK2 | G | G | A | A | C | A | C | A | A | A |
|---|---|---|---|---|---|---|---|---|---|---|
| 339 | | 2.2% | 56.7% | | 59.0% | | | 6.6% | 23.3% | 2.1% |
| 340 | | 1.4% | 31.0% | | 36.0% | | | 2.6% | 19.6% | 1.5% |
| 341 | | 1.9% | 57.1% | | 61.2% | | | 5.7% | 18.1% | 2.0% |

| HEK2-3 | G | T | A | A | A | C | A | A | A | G |
|---|---|---|---|---|---|---|---|---|---|---|
| 339 | | | 0.5% | 1.0% | 19.3% | | 0.6% | 1.5% | 0.7% | |
| 340 | | | 0.2% | 0.4% | 17.2% | | 0.2% | 0.7% | 0.3% | |
| 341 | | | 0.5% | 1.0% | 19.5% | | 0.6% | 1.3% | 0.5% | |

| HEK2-6 | G | A | A | G | A | C | C | A | A | G |
|---|---|---|---|---|---|---|---|---|---|---|
| 339 | | 0.0% | 0.1% | | 7.2% | | | 0.4% | 0.3% | |
| 340 | | 0.0% | 0.0% | | 6.1% | | | 0.2% | 0.1% | |
| 341 | | 0.0% | 0.0% | | 6.6% | | | 0.4% | 0.3% | |

| HEK2-7 | G | A | A | A | A | C | A | A | A | T |
|---|---|---|---|---|---|---|---|---|---|---|
| 339 | | 0.0% | 0.0% | 0.0% | 0.6% | | 0.0% | 0.0% | 0.0% | |
| 340 | | 0.0% | 0.0% | 0.0% | 0.3% | | 0.0% | 0.0% | 0.0% | |
| 341 | | 0.0% | 0.0% | 0.0% | 0.4% | | 0.1% | 0.0% | 0.0% | |

| HEK2-8 | G | A | T | C | A | C | A | A | A | G |
|---|---|---|---|---|---|---|---|---|---|---|
| 339 | | 0.2% | | | 23.9% | | 0.5% | 0.5% | 0.3% | |
| 340 | | 0.1% | | | 26.0% | | 0.2% | 0.2% | 0.1% | |
| 341 | | 0.2% | | | 27.5% | | 0.5% | 0.4% | 0.3% | |

Hek-2 site: 5'-GA$_2$A$_3$CA$_5$CA$_7$A$_8$A$_9$GCA$_{12}$TA$_{14}$GA$_{16}$CTGCGGG-3'

| HEK2 pNMG-369 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #3 | A | 99.93% | 97.44% | 88.96% | 99.03% | 99.17% | 99.59% | 99.96% | 99.97% | 100.0% |
| | C | 0.00% | 0.00% | 0.01% | 0.00% | 0.00% | 0.00% | 0.00% | 0.00% | 0.0% |
| | G | 0.07% | 2.56% | 88.91% | 0.96% | 0.83% | 0.41% | 0.03% | 0.02% | 0.0% |
| | T | 0.00% | 0.01% | 0.02% | 0.01% | 0.00% | 0.00% | 0.01% | 0.00% | 0.0% |

| HEK2 pNMG-370 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #2 | A | 99.94% | 98.55% | 87.73% | 99.71% | 99.40% | 99.80% | 99.96% | 99.97% | 100.0% |
| | C | 0.00% | 0.00% | 0.00% | 0.00% | 0.00% | 0.00% | 0.00% | 0.00% | 0.0% |
| | G | 0.05% | 1.44% | 12.25% | 0.29% | 0.59% | 0.20% | 0.03% | 0.02% | 0.0% |
| | T | 0.01% | 0.01% | 0.02% | 0.00% | 0.00% | 0.00% | 0.01% | 0.00% | 0.0% |

| HEK2 pNMG-371 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #3 | A | 99.91% | 96.97% | 84.25% | 99.11% | 99.06% | 99.41% | 99.96% | 99.98% | 100.0% |
| | C | 0.00% | 0.00% | 0.00% | 0.00% | 0.00% | 0.00% | 0.00% | 0.00% | 0.0% |
| | G | 0.09% | 3.02% | 15.73% | 0.89% | 0.93% | 0.59% | 0.03% | 0.01% | 0.0% |
| | T | 0.00% | 0.00% | 0.01% | 0.00% | 0.00% | 0.00% | 0.01% | 0.00% | 0.0% |

| HEK2 pNMG-360 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.92% | 98.69% | 72.25% | 99.68% | 99.71% | 99.92% | 99.95% | 99.97% | 100.0% |
| | C | 0.00% | 0.00% | 0.01% | 0.00% | 0.00% | 0.00% | 0.00% | 0.00% | 0.0% |
| | G | 0.07% | 1.30% | 27.73% | 0.32% | 0.28% | 0.07% | 0.04% | 0.02% | 0.0% |
| | T | 0.01% | 0.00% | 0.01% | 0.00% | 0.01% | 0.00% | 0.00% | 0.00% | 0.0% |

| HEK2 pNMG-361 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.94% | 98.96% | 89.63% | 99.81% | 99.68% | 99.92% | 99.96% | 99.97% | 100.0% |
| | C | 0.00% | 0.00% | 0.01% | 0.00% | 0.00% | 0.00% | 0.00% | 0.00% | 0.0% |
| | G | 0.05% | 1.04% | 10.36% | 0.18% | 0.31% | 0.08% | 0.01% | 0.02% | 0.0% |
| | T | 0.00% | 0.00% | 0.00% | 0.00% | 0.00% | 0.00% | 0.00% | 0.00% | 0.0% |

| HEK2 pNMG-362 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.96% | 99.14% | 67.24% | 99.78% | 99.79% | 99.86% | 99.91% | 99.98% | 100.0% |
| | C | 0.00% | 0.00% | 0.00% | 0.00% | 0.00% | 0.00% | 0.00% | 0.00% | 0.0% |
| | G | 0.04% | 0.86% | 32.75% | 0.21% | 0.20% | 0.14% | 0.08% | 0.01% | 0.0% |
| | T | 0.00% | 0.01% | 0.01% | 0.00% | 0.00% | 0.00% | 0.01% | 0.00% | 0.0% |

FIGURE 108 (Continued)

Hek-2 site: 5'-GA$_2$A$_3$CA$_5$CA$_7$A$_8$A$_9$GCA$_{12}$TA$_{14}$GA$_{16}$CTGCGGG-3'

| HEK2 pNMG-363 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.92% | 98.65% | 72.39% | 99.68% | 99.71% | 99.92% | 99.95% | 99.97% | 100.0% |
| | C | 0.00% | 0.00% | 0.01% | 0.00% | 0.00% | 0.00% | 0.00% | 0.00% | 0.0% |
| | G | 0.07% | 1.30% | 27.76% | 0.32% | 0.28% | 0.07% | 0.04% | 0.02% | 0.0% |
| | T | 0.01% | 0.00% | 0.01% | 0.00% | 0.01% | 0.00% | 0.00% | 0.00% | 0.0% |

| HEK2 pNMG-364 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.97% | 99.01% | 65.80% | 99.68% | 99.78% | 99.90% | 99.95% | 99.97% | 100.0% |
| | C | 0.00% | 0.00% | 0.00% | 0.00% | 0.00% | 0.00% | 0.00% | 0.00% | 0.0% |
| | G | 0.03% | 0.98% | 34.18% | 0.32% | 0.21% | 0.10% | 0.04% | 0.02% | 0.0% |
| | T | 0.00% | 0.00% | 0.02% | 0.00% | 0.01% | 0.01% | 0.01% | 0.00% | 0.0% |

| HEK2 pNMG-365 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.97% | 99.08% | 72.04% | 99.81% | 99.78% | 99.90% | 99.95% | 99.98% | 100.0% |
| | C | 0.00% | 0.00% | 0.00% | 0.00% | 0.00% | 0.00% | 0.00% | 0.00% | 0.0% |
| | G | 0.03% | 0.91% | 27.94% | 0.18% | 0.21% | 0.10% | 0.04% | 0.01% | 0.0% |
| | T | 0.00% | 0.00% | 0.01% | 0.00% | 0.01% | 0.00% | 0.01% | 0.00% | 0.0% |

| HEK2 pNMG-366 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.90% | 98.23% | 71.10% | 99.59% | 99.73% | 99.85% | 99.93% | 99.97% | 100.0% |
| | C | 0.00% | 0.00% | 0.00% | 0.00% | 0.00% | 0.00% | 0.00% | 0.00% | 0.0% |
| | G | 0.10% | 1.76% | 28.89% | 0.41% | 0.26% | 0.15% | 0.06% | 0.02% | 0.0% |
| | T | 0.00% | 0.00% | 0.01% | 0.00% | 0.00% | 0.00% | 0.01% | 0.00% | 0.0% |

| HEK2 pNMG-367 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.92% | 98.73% | 66.89% | 99.68% | 99.78% | 99.90% | 99.95% | 99.97% | 100.0% |
| | C | 0.00% | 0.00% | 0.01% | 0.00% | 0.00% | 0.00% | 0.00% | 0.00% | 0.0% |
| | G | 0.08% | 1.26% | 33.09% | 0.32% | 0.21% | 0.10% | 0.04% | 0.02% | 0.0% |
| | T | 0.00% | 0.01% | 0.01% | 0.00% | 0.01% | 0.01% | 0.01% | 0.00% | 0.0% |

| HEK2 pNMG-368 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.97% | 99.72% | 99.32% | 99.95% | 99.92% | 99.96% | 99.97% | 99.98% | 100.0% |
| | C | 0.00% | 0.00% | 0.00% | 0.00% | 0.00% | 0.00% | 0.00% | 0.00% | 0.0% |
| | G | 0.02% | 0.27% | 0.67% | 0.05% | 0.08% | 0.03% | 0.02% | 0.01% | 0.0% |
| | T | 0.00% | 0.00% | 0.01% | 0.00% | 0.00% | 0.00% | 0.01% | 0.00% | 0.0% |

FIGURE 109

HEK2-3 site: 5'-GTA$_3$A$_4$A$_5$CA$_7$A$_8$A$_9$GCA$_{12}$TA$_{14}$GA$_{16}$CTGAGGG-3'

| HEK2-3 pNMG-369 | | 3 A | 4 A | 5 A | 7 A | 8 A | 9 A | 12 A | 14 A | 16 A |
|---|---|---|---|---|---|---|---|---|---|---|
| | A | 99.73% | 99.59% | 93.69% | 99.55% | 99.15% | 99.93% | 99.96% | 99.98% | 100.00% |
| | C | 0.01% | 0.00% | 0.01% | 0.01% | 0.00% | 0.00% | 0.01% | 0.00% | 0.00% |
| | G | 0.25% | 0.41% | 6.30% | 0.44% | 0.85% | 0.07% | 0.02% | 0.01% | 0.00% |
| | T | 0.01% | 0.01% | 0.00% | 0.00% | 0.00% | 0.00% | 0.01% | 0.00% | 0.00% |

| HEK2-3 pNMG-370 | | 3 A | 4 A | 5 A | 7 A | 8 A | 9 A | 12 A | 14 A | 16 A |
|---|---|---|---|---|---|---|---|---|---|---|
| | A | 99.93% | 99.89% | 94.96% | 99.92% | 99.74% | 99.98% | 99.99% | 99.99% | 99.99% |
| | C | 0.01% | 0.00% | 0.01% | 0.01% | 0.00% | 0.00% | 0.00% | 0.00% | 0.00% |
| | G | 0.06% | 0.11% | 5.03% | 0.07% | 0.25% | 0.02% | 0.00% | 0.01% | 0.00% |
| | T | 0.01% | 0.00% | 0.00% | 0.00% | 0.01% | 0.00% | 0.00% | 0.00% | 0.01% |

| HEK2-3 pNMG-371 | | 3 A | 4 A | 5 A | 7 A | 8 A | 9 A | 12 A | 14 A | 16 A |
|---|---|---|---|---|---|---|---|---|---|---|
| | A | 99.69% | 99.59% | 93.55% | 99.75% | 99.46% | 99.94% | 99.96% | 99.98% | 99.99% |
| | C | 0.01% | 0.01% | 0.01% | 0.02% | 0.02% | 0.01% | 0.02% | 0.01% | 0.01% |
| | G | 0.30% | 0.40% | 6.45% | 0.23% | 0.52% | 0.05% | 0.01% | 0.01% | 0.01% |
| | T | 0.00% | 0.00% | 0.00% | 0.00% | 0.00% | 0.00% | 0.01% | 0.00% | 0.00% |

| HEK2-3 pNMG-360 | | 3 A | 4 A | 5 A | 7 A | 8 A | 9 A | 12 A | 14 A | 16 A |
|---|---|---|---|---|---|---|---|---|---|---|
| | A | 99.82% | 99.80% | 98.74% | 99.90% | 99.92% | 99.98% | 99.98% | 99.99% | 99.99% |
| | C | 0.00% | 0.00% | 0.01% | 0.02% | 0.02% | 0.01% | 0.00% | 0.00% | 0.00% |
| | G | 0.18% | 0.10% | 1.25% | 0.08% | 0.06% | 0.01% | 0.01% | 0.01% | 0.01% |
| | T | 0.00% | 0.00% | 0.00% | 0.00% | 0.00% | 0.00% | 0.01% | 0.00% | 0.00% |

| HEK2-3 pNMG-361 | | 3 A | 4 A | 5 A | 7 A | 8 A | 9 A | 12 A | 14 A | 16 A |
|---|---|---|---|---|---|---|---|---|---|---|
| | A | 99.97% | 99.96% | 99.54% | 99.97% | 99.98% | 99.99% | 99.98% | 99.99% | 99.99% |
| | C | 0.00% | 0.00% | 0.01% | 0.01% | 0.00% | 0.00% | 0.00% | 0.00% | 0.00% |
| | G | 0.03% | 0.02% | 0.44% | 0.02% | 0.01% | 0.00% | 0.01% | 0.00% | 0.01% |
| | T | 0.00% | 0.00% | 0.00% | 0.00% | 0.00% | 0.00% | 0.01% | 0.01% | 0.00% |

| HEK2-3 pNMG-362 | | 3 A | 4 A | 5 A | 7 A | 8 A | 9 A | 12 A | 14 A | 16 A |
|---|---|---|---|---|---|---|---|---|---|---|
| | A | 99.91% | 99.94% | 98.06% | 99.93% | 99.89% | 99.96% | 99.98% | 99.98% | 99.99% |
| | C | 0.01% | 0.00% | 0.00% | 0.01% | 0.00% | 0.00% | 0.00% | 0.00% | 0.00% |
| | G | 0.09% | 0.06% | 1.93% | 0.06% | 0.10% | 0.04% | 0.02% | 0.02% | 0.00% |
| | T | 0.00% | 0.00% | 0.00% | 0.00% | 0.00% | 0.00% | 0.00% | 0.00% | 0.01% |

FIGURE 109 (Continued)

HEK2-3 site: 5'-GTA$_3$A$_4$A$_5$CA$_7$A$_8$A$_9$GCA$_{12}$TA$_{14}$GA$_{16}$CTGAGGG-3'

| HEK2-3 pNMG-363 | | 3 A | 4 A | 5 A | 7 A | 8 A | 9 A | 12 A | 14 A | 16 A |
|---|---|---|---|---|---|---|---|---|---|---|
| | A | 99.80% | 99.91% | 97.58% | 99.90% | 99.89% | 99.97% | 99.96% | 99.99% | 99.99% |
| | C | 0.00% | 0.00% | 0.01% | 0.00% | 0.01% | 0.00% | 0.01% | 0.00% | 0.00% |
| | G | 0.19% | 0.09% | 2.40% | 0.09% | 0.10% | 0.03% | 0.02% | 0.01% | 0.00% |
| | T | 0.00% | 0.00% | 0.00% | 0.00% | 0.01% | 0.00% | 0.02% | 0.00% | 0.00% |

| HEK2-3 pNMG-364 | | 3 A | 4 A | 5 A | 7 A | 8 A | 9 A | 12 A | 14 A | 16 A |
|---|---|---|---|---|---|---|---|---|---|---|
| | A | 99.96% | 99.97% | 99.47% | 99.96% | 99.98% | 100.00% | 99.99% | 99.98% | 100.00% |
| | C | 0.01% | 0.00% | 0.01% | 0.01% | 0.00% | 0.00% | 0.00% | 0.00% | 0.00% |
| | G | 0.03% | 0.02% | 0.51% | 0.04% | 0.01% | 0.00% | 0.00% | 0.01% | 0.00% |
| | T | 0.01% | 0.00% | 0.01% | 0.00% | 0.00% | 0.00% | 0.00% | 0.01% | 0.00% |

| HEK2-3 pNMG-365 | | 3 A | 4 A | 5 A | 7 A | 8 A | 9 A | 12 A | 14 A | 16 A |
|---|---|---|---|---|---|---|---|---|---|---|
| | A | 99.91% | 99.97% | 98.49% | 99.95% | 99.92% | 99.97% | 99.92% | 99.98% | 100.00% |
| | C | 0.00% | 0.00% | 0.00% | 0.01% | 0.01% | 0.00% | 0.00% | 0.00% | 0.00% |
| | G | 0.09% | 0.02% | 1.51% | 0.04% | 0.07% | 0.02% | 0.07% | 0.01% | 0.00% |
| | T | 0.00% | 0.00% | 0.00% | 0.00% | 0.00% | 0.00% | 0.01% | 0.00% | 0.00% |

| HEK2-3 pNMG-366 | | 3 A | 4 A | 5 A | 7 A | 8 A | 9 A | 12 A | 14 A | 16 A |
|---|---|---|---|---|---|---|---|---|---|---|
| | A | 99.70% | 99.86% | 97.73% | 99.68% | 99.77% | 99.97% | 99.98% | 99.99% | 99.99% |
| | C | 0.00% | 0.00% | 0.00% | 0.01% | 0.01% | 0.01% | 0.00% | 0.00% | 0.00% |
| | G | 0.29% | 0.14% | 2.27% | 0.30% | 0.22% | 0.02% | 0.02% | 0.00% | 0.00% |
| | T | 0.00% | 0.00% | 0.00% | 0.00% | 0.00% | 0.00% | 0.00% | 0.00% | 0.01% |

| HEK2-3 pNMG-367 | | 3 A | 4 A | 5 A | 7 A | 8 A | 9 A | 12 A | 14 A | 16 A |
|---|---|---|---|---|---|---|---|---|---|---|
| | A | 99.87% | 99.89% | 97.80% | 99.87% | 99.91% | 99.97% | 99.92% | 99.98% | 99.99% |
| | C | 0.00% | 0.00% | 0.00% | 0.01% | 0.01% | 0.00% | 0.01% | 0.00% | 0.00% |
| | G | 0.12% | 0.10% | 2.19% | 0.11% | 0.08% | 0.02% | 0.05% | 0.02% | 0.01% |
| | T | 0.01% | 0.00% | 0.00% | 0.00% | 0.00% | 0.00% | 0.01% | 0.01% | 0.00% |

| HEK2-3 pNMG-368 | | 3 A | 4 A | 5 A | 7 A | 8 A | 9 A | 12 A | 14 A | 16 A |
|---|---|---|---|---|---|---|---|---|---|---|
| | A | 99.97% | 100.00% | 100.00% | 99.99% | 99.98% | 100.00% | 99.98% | 99.98% | 100.00% |
| | C | 0.00% | 0.00% | 0.00% | 0.01% | 0.01% | 0.00% | 0.00% | 0.01% | 0.00% |
| | G | 0.02% | 0.00% | 0.00% | 0.00% | 0.00% | 0.00% | 0.01% | 0.01% | 0.00% |
| | T | 0.00% | 0.00% | 0.00% | 0.01% | 0.01% | 0.00% | 0.01% | 0.00% | 0.00% |

FIGURE 110

HEK2-6: 5'-GA A GA CCA A GGA TA GACTGCTGG-3'
              2 3    5   8 9    12  14

| HEK2-6 pNMG-369 | | 2 | 3 | 5 | 8 | 9 | 12 | 14 |
|---|---|---|---|---|---|---|---|---|
| | | A | A | A | A | A | A | A |
| | A | 99.80% | 99.94% | 95.27% | 99.70% | 99.74% | 99.94% | 99.94% |
| | C | 0.07% | 0.06% | 0.00% | 0.00% | 0.00% | 0.00% | 0.00% |
| | G | 0.13% | 0.00% | 4.67% | 0.30% | 0.26% | 0.06% | 0.06% |
| | T | 0.00% | 0.00% | 0.06% | 0.00% | 0.00% | 0.00% | 0.00% |

| HEK2-6 pNMG-370 | | 2 | 3 | 5 | 8 | 9 | 12 | 14 |
|---|---|---|---|---|---|---|---|---|
| | | A | A | A | A | A | A | A |
| | A | 99.97% | 99.98% | 96.45% | 99.77% | 99.92% | 99.98% | 99.98% |
| | C | 0.03% | 0.02% | 0.00% | 0.00% | 0.03% | 0.00% | 0.00% |
| | G | 0.00% | 0.00% | 3.50% | 0.23% | 0.03% | 0.02% | 0.02% |
| | T | 0.00% | 0.00% | 0.05% | 0.00% | 0.03% | 0.00% | 0.00% |

| HEK2-6 pNMG-371 | | 2 | 3 | 5 | 8 | 9 | 12 | 14 |
|---|---|---|---|---|---|---|---|---|
| | | A | A | A | A | A | A | A |
| | A | 99.97% | 99.94% | 96.33% | 99.80% | 99.78% | 100.00% | 100.00% |
| | C | 0.00% | 0.03% | 0.00% | 0.00% | 0.00% | 0.00% | 0.00% |
| | G | 0.03% | 0.00% | 3.67% | 0.20% | 0.19% | 0.00% | 0.00% |
| | T | 0.00% | 0.03% | 0.00% | 0.00% | 0.03% | 0.00% | 0.00% |

| HEK2-6 pNMG-360 | | 2 | 3 | 5 | 8 | 9 | 12 | 14 |
|---|---|---|---|---|---|---|---|---|
| | | A | A | A | A | A | A | A |
| | A | 100.00% | 99.96% | 99.03% | 99.96% | 99.91% | 99.96% | 100.00% |
| | C | 0.00% | 0.04% | 0.00% | 0.00% | 0.09% | 0.00% | 0.00% |
| | G | 0.00% | 0.00% | 0.97% | 0.04% | 0.00% | 0.04% | 0.00% |
| | T | 0.00% | 0.00% | 0.00% | 0.00% | 0.00% | 0.00% | 0.00% |

| HEK2-6 361 | | 2 | 3 | 5 | 8 | 9 | 12 | 14 |
|---|---|---|---|---|---|---|---|---|
| | | A | A | A | A | A | A | A |
| | A | 99.97% | 99.97% | 99.67% | 100.00% | 99.97% | 99.97% | 100.00% |
| | C | 0.00% | 0.00% | 0.00% | 0.00% | 0.00% | 0.00% | 0.00% |
| | G | 0.03% | 0.03% | 0.30% | 0.00% | 0.00% | 0.03% | 0.00% |
| | T | 0.00% | 0.00% | 0.03% | 0.00% | 0.03% | 0.00% | 0.00% |

| HEK2-6 362 | | 2 | 3 | 5 | 8 | 9 | 12 | 14 |
|---|---|---|---|---|---|---|---|---|
| | | A | A | A | A | A | A | A |
| | A | 99.96% | 99.92% | 98.65% | 99.94% | 99.98% | 99.94% | 99.98% |
| | C | 0.02% | 0.08% | 0.00% | 0.00% | 0.00% | 0.00% | 0.00% |
| | G | 0.02% | 0.00% | 1.35% | 0.04% | 0.02% | 0.04% | 0.02% |
| | T | 0.00% | 0.00% | 0.00% | 0.02% | 0.00% | 0.02% | 0.00% |

FIGURE 110 (Continued)

HEK2-6: 5'-GA$_2$A$_3$GA$_5$CCA$_8$A$_9$GGA$_{12}$TA$_{14}$GACTGCTGG-3'

| HEK2-6 363 | | 2 A | 3 A | 5 A | 8 A | 9 A | 12 A | 14 A |
|---|---|---|---|---|---|---|---|---|
| | A | 99.97% | 99.97% | 95.64% | 99.93% | 99.99% | 99.99% | 99.99% |
| | C | 0.00% | 0.00% | 0.00% | 0.00% | 0.00% | 0.00% | 0.00% |
| | G | 0.03% | 0.03% | 4.36% | 0.05% | 0.01% | 0.00% | 0.00% |
| | T | 0.00% | 0.00% | 0.00% | 0.01% | 0.00% | 0.01% | 0.01% |

| HEK2-6 364 | | 2 A | 3 A | 5 A | 8 A | 9 A | 12 A | 14 A |
|---|---|---|---|---|---|---|---|---|
| | A | 99.98% | 99.98% | 99.59% | 99.98% | 99.90% | 99.98% | 100.00% |
| | C | 0.00% | 0.00% | 0.00% | 0.00% | 0.02% | 0.00% | 0.00% |
| | G | 0.00% | 0.02% | 0.39% | 0.02% | 0.06% | 0.02% | 0.00% |
| | T | 0.02% | 0.00% | 0.02% | 0.00% | 0.02% | 0.00% | 0.00% |

| HEK2-6 365 | | 2 A | 3 A | 5 A | 8 A | 9 A | 12 A | 14 A |
|---|---|---|---|---|---|---|---|---|
| | A | 99.95% | 100.00% | 97.12% | 99.95% | 99.82% | 99.85% | 100.00% |
| | C | 0.00% | 0.00% | 0.00% | 0.00% | 0.00% | 0.03% | 0.00% |
| | G | 0.03% | 0.00% | 2.86% | 0.02% | 0.18% | 0.10% | 0.00% |
| | T | 0.03% | 0.00% | 0.02% | 0.02% | 0.00% | 0.03% | 0.00% |

| HEK2-6 366 | | 2 A | 3 A | 5 A | 8 A | 9 A | 12 A | 14 A |
|---|---|---|---|---|---|---|---|---|
| | A | 99.90% | 99.96% | 97.54% | 99.82% | 99.98% | 99.88% | 99.98% |
| | C | 0.04% | 0.00% | 0.00% | 0.00% | 0.02% | 0.00% | 0.00% |
| | G | 0.02% | 0.04% | 2.46% | 0.15% | 0.00% | 0.08% | 0.02% |
| | T | 0.04% | 0.00% | 0.00% | 0.04% | 0.00% | 0.04% | 0.00% |

| HEK2-6 367 | | 2 A | 3 A | 5 A | 8 A | 9 A | 12 A | 14 A |
|---|---|---|---|---|---|---|---|---|
| | A | 99.89% | 99.99% | 97.00% | 99.93% | 99.94% | 99.96% | 99.99% |
| | C | 0.03% | 0.00% | 0.01% | 0.01% | 0.01% | 0.01% | 0.00% |
| | G | 0.06% | 0.01% | 2.97% | 0.04% | 0.03% | 0.00% | 0.00% |
| | T | 0.02% | 0.00% | 0.01% | 0.01% | 0.01% | 0.03% | 0.01% |

| HEK2-6 368 | | 2 A | 3 A | 5 A | 8 A | 9 A | 12 A | 14 A |
|---|---|---|---|---|---|---|---|---|
| | A | 99.92% | 99.96% | 99.96% | 99.99% | 99.99% | 99.98% | 100.00% |
| | C | 0.02% | 0.02% | 0.00% | 0.00% | 0.01% | 0.00% | 0.00% |
| | G | 0.04% | 0.02% | 0.01% | 0.01% | 0.00% | 0.01% | 0.00% |
| | T | 0.02% | 0.00% | 0.03% | 0.00% | 0.00% | 0.01% | 0.00% |

FIGURE 111

HEK2-7: 3'-CCTGCAGT CAAT GAT T T GT T T T G-5'
                    16     12   9 8 7   5 4 3 2

| HEK2-7 pNMG-369 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.00% | 0.01% | 0.00% | 0.01% | 0.00% | 0.00% | 0.00% | 0.00% | 0.00% |
| | C | 0.01% | 0.01% | 0.08% | 0.09% | 0.05% | 0.83% | 0.06% | 0.03% | 0.02% |
| | G | 0.00% | 0.00% | 0.00% | 0.00% | 0.00% | 0.00% | 0.00% | 0.00% | 0.00% |
| | T | 99.98% | 99.98% | 99.91% | 99.91% | 99.95% | 99.16% | 99.93% | 99.96% | 99.98% |

| HEK2-7 pNMG-370 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.01% | 0.01% | 0.00% | 0.01% | 0.00% | 0.00% | 0.01% | 0.01% | 0.01% |
| | C | 0.00% | 0.00% | 0.01% | 0.00% | 0.01% | 0.24% | 0.01% | 0.01% | 0.01% |
| | G | 0.01% | 0.00% | 0.00% | 0.00% | 0.01% | 0.01% | 0.01% | 0.00% | 0.00% |
| | T | 99.99% | 99.99% | 99.99% | 99.99% | 99.98% | 99.75% | 99.98% | 99.98% | 99.98% |

| HEK2-7 pNMG-371 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.00% | 0.00% | 0.00% | 0.00% | 0.00% | 0.01% | 0.00% | 0.00% | 0.00% |
| | C | 0.00% | 0.01% | 0.06% | 0.04% | 0.10% | 0.35% | 0.02% | 0.01% | 0.00% |
| | G | 0.00% | 0.00% | 0.00% | 0.00% | 0.00% | 0.00% | 0.00% | 0.00% | 0.03% |
| | T | 100.00% | 99.99% | 99.94% | 99.96% | 99.90% | 99.63% | 99.98% | 99.99% | 99.97% |

| HEK2-7 pNMG-360 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.00% | 0.00% | 0.00% | 0.01% | 0.01% | 0.01% | 0.00% | 0.00% | 0.01% |
| | C | 0.01% | 0.00% | 0.01% | 0.03% | 0.00% | 0.09% | 0.03% | 0.02% | 0.02% |
| | G | 0.00% | 0.00% | 0.01% | 0.00% | 0.00% | 0.00% | 0.00% | 0.00% | 0.01% |
| | T | 99.99% | 100.00% | 99.98% | 99.95% | 99.99% | 99.89% | 99.97% | 99.98% | 99.95% |

| HEK2-7 pNMG-361 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.02% | 0.02% | 0.00% | 0.00% | 0.00% | 0.00% | 0.00% | 0.00% | 0.00% |
| | C | 0.02% | 0.04% | 0.00% | 0.00% | 0.02% | 0.06% | 0.02% | 0.00% | 0.02% |
| | G | 0.00% | 0.00% | 0.00% | 0.00% | 0.00% | 0.00% | 0.00% | 0.00% | 0.00% |
| | T | 99.95% | 99.94% | 100.00% | 100.00% | 99.98% | 99.94% | 99.98% | 100.00% | 99.98% |

| HEK2-7 pNMG-362 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.02% | 0.00% | 0.00% | 0.00% | 0.00% | 0.00% | 0.00% | 0.00% | 0.02% |
| | C | 0.00% | 0.00% | 0.00% | 0.05% | 0.00% | 0.10% | 0.00% | 0.05% | 0.02% |
| | G | 0.00% | 0.00% | 0.00% | 0.00% | 0.00% | 0.00% | 0.00% | 0.00% | 0.00% |
| | T | 99.98% | 100.00% | 100.00% | 99.95% | 100.00% | 99.90% | 100.00% | 99.95% | 99.95% |

FIGURE 111 (Continued)

HEK2-7: 3'-CCTGCAGT CAAT GATTTGTTTTG-5'
                       10    12    9 8 7  5 4 3 2

| HEK2-7 pNMG-363 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.03% | 0.00% | 0.00% | 0.00% | 0.00% | 0.00% |
| | C | 0.00% | 0.03% | 0.00% | 0.00% | 0.00% | 0.16% | 0.00% | 0.00% | 0.00% |
| | G | 0.00% | 0.00% | 0.00% | 0.00% | 0.00% | 0.00% | 0.00% | 0.00% | 0.00% |
| | T | 100.00% | 99.97% | 100.00% | 99.97% | 100.00% | 99.84% | 100.00% | 100.00% | 100.00% |

| HEK2-7 pNMG-364 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.02% | 0.00% | 0.00% | 0.00% | 0.00% | 0.00% |
| | C | 0.02% | 0.02% | 0.00% | 0.00% | 0.00% | 0.02% | 0.02% | 0.02% | 0.04% |
| | G | 0.00% | 0.00% | 0.00% | 0.00% | 0.00% | 0.00% | 0.00% | 0.00% | 0.00% |
| | T | 99.98% | 99.98% | 100.00% | 99.98% | 100.00% | 99.98% | 99.98% | 99.98% | 99.96% |

| HEK2-7 pNMG-365 | | 16 T | 12 T | 9 T | 8 T | 7 T | 5 T | 4 T | 3 T | 2 T |
|---|---|---|---|---|---|---|---|---|---|---|
| | A | 0.01% | 0.00% | 0.00% | 0.00% | 0.00% | 0.00% | 0.00% | 0.00% | 0.01% |
| | C | 0.01% | 0.01% | 0.04% | 0.01% | 0.01% | 0.07% | 0.01% | 0.01% | 0.00% |
| | G | 0.00% | 0.00% | 0.00% | 0.00% | 0.00% | 0.00% | 0.00% | 0.00% | 0.01% |
| | T | 99.98% | 99.99% | 99.95% | 99.98% | 99.99% | 99.93% | 99.99% | 99.99% | 99.97% |

| HEK2-7 pNMG-366 | | 16 T | 12 T | 9 T | 8 T | 7 T | 5 T | 4 T | 3 T | 2 T |
|---|---|---|---|---|---|---|---|---|---|---|
| | A | 0.01% | 0.01% | 0.01% | 0.00% | 0.01% | 0.00% | 0.00% | 0.01% | 0.00% |
| | C | 0.02% | 0.02% | 0.02% | 0.04% | 0.03% | 0.07% | 0.00% | 0.02% | 0.01% |
| | G | 0.00% | 0.00% | 0.00% | 0.01% | 0.00% | 0.01% | 0.00% | 0.00% | 0.00% |
| | T | 99.98% | 99.98% | 99.97% | 99.96% | 99.97% | 99.92% | 100.00% | 99.98% | 99.99% |

| HEK2-7 pNMG-367 | | 16 T | 12 T | 9 T | 8 T | 7 T | 5 T | 4 T | 3 T | 2 T |
|---|---|---|---|---|---|---|---|---|---|---|
| | A | 0.00% | 0.01% | 0.00% | 0.00% | 0.00% | 0.00% | 0.00% | 0.00% | 0.00% |
| | C | 0.01% | 0.03% | 0.01% | 0.01% | 0.00% | 0.07% | 0.01% | 0.02% | 0.00% |
| | G | 0.00% | 0.00% | 0.00% | 0.00% | 0.00% | 0.01% | 0.00% | 0.00% | 0.00% |
| | T | 99.99% | 99.96% | 99.99% | 99.99% | 100.00% | 99.92% | 99.99% | 99.98% | 99.99% |

| HEK2-7 pNMG-368 | | 16 T | 12 T | 9 T | 8 T | 7 T | 5 T | 4 T | 3 T | 2 T |
|---|---|---|---|---|---|---|---|---|---|---|
| | A | 0.01% | 0.00% | 0.00% | 0.01% | 0.01% | 0.00% | 0.00% | 0.00% | 0.01% |
| | C | 0.00% | 0.00% | 0.00% | 0.01% | 0.01% | 0.00% | 0.00% | 0.02% | 0.01% |
| | G | 0.00% | 0.00% | 0.00% | 0.01% | 0.00% | 0.02% | 0.00% | 0.00% | 0.00% |
| | T | 99.99% | 100.00% | 99.99% | 99.97% | 99.98% | 99.97% | 100.00% | 99.97% | 99.98% |

FIGURE 112

HEK2-10: 3'-CCATCAT T C T AT T CT T T AT GT T C-5'
                     17 16  14 12 11  9 8  7  5  3 2

| HEK2-10 pNMG-369 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.04% | 0.00% | 0.00% | 0.00% | 0.00% | 0.00% | 0.00% | 0.01% | 0.01% | 0.00% |
| | C | 0.02% | 0.01% | 0.01% | 0.14% | 0.38% | 0.31% | 0.88% | 1.20% | 7.43% | 1.02% | 0.27% |
| | G | 0.01% | 0.00% | 0.00% | 0.00% | 0.01% | 0.00% | 0.00% | 0.01% | 0.00% | 0.00% | 0.00% |
| | T | 99.97% | 99.96% | 99.99% | 99.86% | 99.62% | 99.68% | 99.11% | 98.79% | 92.56% | 98.97% | 99.73% |

| HEK2-10 pNMG-370 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.05% | 0.00% | 0.01% | 0.01% | 0.01% | 0.00% | 0.00% | 0.01% | 0.00% | 0.01% |
| | C | 0.01% | 0.01% | 0.02% | 0.29% | 0.10% | 0.08% | 0.60% | 0.43% | 3.51% | 0.30% | 0.30% |
| | G | 0.00% | 0.00% | 0.00% | 0.00% | 0.00% | 0.00% | 0.01% | 0.00% | 0.00% | 0.00% | 0.00% |
| | T | 99.98% | 99.94% | 99.97% | 99.70% | 99.89% | 99.91% | 99.39% | 99.57% | 96.48% | 99.70% | 99.69% |

| HEK2-10 pNMG-371 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.10% | 0.01% | 0.01% | 0.00% | 0.00% | 0.00% | 0.01% | 0.01% | 0.00% | 0.00% |
| | C | 0.01% | 0.01% | 0.01% | 0.47% | 0.20% | 0.30% | 1.12% | 1.35% | 7.27% | 0.70% | 0.54% |
| | G | 0.00% | 0.00% | 0.00% | 0.00% | 0.01% | 0.00% | 0.00% | 0.00% | 0.00% | 0.00% | 0.00% |
| | T | 99.98% | 99.89% | 99.98% | 99.51% | 99.78% | 99.70% | 98.88% | 98.64% | 92.72% | 99.29% | 99.46% |

| HEK2-10 pNMG-360 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.09% | 0.00% | 0.00% | 0.01% | 0.01% | 0.00% | 0.01% | 0.00% | 0.01% | 0.00% |
| | C | 0.01% | 0.01% | 0.03% | 0.60% | 0.24% | 0.03% | 0.66% | 0.14% | 1.20% | 0.17% | 0.62% |
| | G | 0.01% | 0.00% | 0.00% | 0.00% | 0.02% | 0.00% | 0.02% | 0.01% | 0.00% | 0.00% | 0.00% |
| | T | 99.96% | 99.91% | 99.97% | 99.40% | 99.74% | 99.96% | 99.32% | 99.84% | 98.80% | 99.81% | 99.38% |

| HEK2-10 pNMG-361 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.16% | 0.00% | 0.00% | 0.04% | 0.03% | 0.00% | 0.01% | 0.01% | 0.01% | 0.01% |
| | C | 0.01% | 0.00% | 0.06% | 0.52% | 0.12% | 0.01% | 0.58% | 0.11% | 0.21% | 0.04% | 0.42% |
| | G | 0.01% | 0.00% | 0.00% | 0.00% | 0.02% | 0.00% | 0.02% | 0.03% | 0.00% | 0.00% | 0.00% |
| | T | 99.98% | 99.84% | 99.93% | 99.47% | 99.82% | 99.96% | 99.40% | 99.85% | 99.78% | 99.95% | 99.57% |

| HEK2-10 pNMG-362 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.07% | 0.01% | 0.00% | 0.00% | 0.00% | 0.01% | 0.00% | 0.00% | 0.01% | 0.01% |
| | C | 0.01% | 0.01% | 0.01% | 0.26% | 1.06% | 0.11% | 0.40% | 0.26% | 1.37% | 0.17% | 0.28% |
| | G | 0.01% | 0.00% | 0.00% | 0.00% | 0.01% | 0.00% | 0.00% | 0.00% | 0.00% | 0.00% | 0.00% |
| | T | 99.97% | 99.92% | 99.98% | 99.73% | 98.93% | 99.89% | 99.59% | 99.73% | 98.62% | 99.81% | 99.71% |

FIGURE 112 (Continued)

HEK2-10: 3'-CCATCAT T C T AT T CT T T AT GT T C-5'
                        17 16  14  12 11  9 8 7  5  3 2

| HEK2-10 pNMG-363 | 17 T | 16 T | 14 T | 12 T | 11 T | 9 T | 8 T | 7 T | 5 T | 3 T | 2 T |
|---|---|---|---|---|---|---|---|---|---|---|---|
| A | 0.01% | 0.02% | 0.00% | 0.01% | 0.01% | 0.00% | 0.00% | 0.01% | 0.01% | 0.00% | 0.01% |
| C | 0.02% | 0.01% | 0.01% | 0.15% | 1.24% | 0.13% | 0.30% | 0.35% | 3.03% | 0.41% | 0.23% |
| G | 0.01% | 0.00% | 0.00% | 0.00% | 0.01% | 0.00% | 0.00% | 0.00% | 0.00% | 0.00% | 0.00% |
| T | 99.97% | 99.97% | 99.98% | 99.85% | 98.74% | 99.87% | 99.69% | 99.64% | 96.96% | 99.58% | 99.76% |

| HEK2-10 pNMG-364 | 17 T | 16 T | 14 T | 12 T | 11 T | 9 T | 8 T | 7 T | 5 T | 3 T | 2 T |
|---|---|---|---|---|---|---|---|---|---|---|---|
| A | 0.00% | 0.07% | 0.01% | 0.00% | 0.00% | 0.00% | 0.01% | 0.00% | 0.00% | 0.00% | 0.00% |
| C | 0.02% | 0.01% | 0.01% | 0.38% | 0.04% | 0.01% | 0.39% | 0.04% | 0.49% | 0.14% | 0.36% |
| G | 0.01% | 0.00% | 0.00% | 0.00% | 0.01% | 0.00% | 0.00% | 0.00% | 0.00% | 0.00% | 0.00% |
| T | 99.97% | 99.92% | 99.98% | 99.61% | 99.96% | 99.99% | 99.60% | 99.96% | 99.51% | 99.86% | 99.64% |

| HEK2-10 pNMG-365 | 17 T | 16 T | 14 T | 12 T | 11 T | 9 T | 8 T | 7 T | 5 T | 3 T | 2 T |
|---|---|---|---|---|---|---|---|---|---|---|---|
| A | 0.00% | 0.12% | 0.00% | 0.00% | 0.00% | 0.00% | 0.00% | 0.00% | 0.01% | 0.01% | 0.01% |
| C | 0.01% | 0.01% | 0.02% | 0.40% | 1.68% | 0.06% | 0.48% | 0.13% | 1.51% | 0.24% | 0.40% |
| G | 0.00% | 0.00% | 0.00% | 0.00% | 0.00% | 0.00% | 0.01% | 0.00% | 0.00% | 0.00% | 0.00% |
| T | 99.99% | 99.87% | 99.97% | 99.60% | 98.31% | 99.94% | 99.51% | 99.86% | 98.48% | 99.75% | 99.58% |

| HEK2-10 pNMG-366 | 17 T | 16 T | 14 T | 12 T | 11 T | 9 T | 8 T | 7 T | 5 T | 3 T | 2 T |
|---|---|---|---|---|---|---|---|---|---|---|---|
| A | 0.00% | 0.02% | 0.01% | 0.01% | 0.00% | 0.00% | 0.01% | 0.00% | 0.00% | 0.01% | 0.00% |
| C | 0.01% | 0.01% | 0.01% | 0.08% | 0.28% | 0.15% | 0.35% | 0.66% | 2.82% | 0.61% | 0.31% |
| G | 0.00% | 0.00% | 0.00% | 0.00% | 0.00% | 0.00% | 0.00% | 0.00% | 0.00% | 0.00% | 0.00% |
| T | 99.99% | 99.97% | 99.98% | 99.91% | 99.71% | 99.85% | 99.64% | 99.33% | 97.17% | 99.38% | 99.68% |

| HEK2-10 pNMG-367 | 17 T | 16 T | 14 T | 12 T | 11 T | 9 T | 8 T | 7 T | 5 T | 3 T | 2 T |
|---|---|---|---|---|---|---|---|---|---|---|---|
| A | 0.01% | 0.07% | 0.01% | 0.01% | 0.00% | 0.00% | 0.00% | 0.00% | 0.00% | 0.01% | 0.01% |
| C | 0.01% | 0.01% | 0.01% | 0.38% | 0.84% | 0.11% | 0.52% | 0.26% | 2.27% | 0.27% | 0.51% |
| G | 0.00% | 0.00% | 0.00% | 0.00% | 0.01% | 0.00% | 0.00% | 0.00% | 0.00% | 0.00% | 0.00% |
| T | 99.98% | 99.92% | 99.98% | 99.61% | 99.15% | 99.89% | 99.47% | 99.74% | 97.73% | 99.72% | 99.48% |

| HEK2-10 pNMG-368 | 17 T | 16 T | 14 T | 12 T | 11 T | 9 T | 8 T | 7 T | 5 T | 3 T | 2 T |
|---|---|---|---|---|---|---|---|---|---|---|---|
| A | 0.01% | 0.05% | 0.01% | 0.00% | 0.01% | 0.00% | 0.00% | 0.00% | 0.01% | 0.00% | 0.01% |
| C | 0.02% | 0.01% | 0.01% | 0.23% | 0.01% | 0.01% | 0.21% | 0.01% | 0.02% | 0.01% | 0.19% |
| G | 0.01% | 0.00% | 0.00% | 0.00% | 0.01% | 0.00% | 0.00% | 0.01% | 0.00% | 0.00% | 0.00% |
| T | 99.97% | 99.94% | 99.98% | 99.76% | 99.96% | 99.98% | 99.78% | 99.98% | 99.97% | 99.99% | 99.79% |

FIGURE 113

Hek3- 5'-GGCCCA GA CTGA GCA CGTGATGG-3'
         6      8     12    15

| HEK3 pNMG-360 | | 6 A | 8 A | 12 A | 15 A |
|---|---|---|---|---|---|
| | A | 99.79% | 99.69% | 99.90% | 99.99% |
| | C | 0.00% | 0.00% | 0.01% | 0.00% |
| | G | 0.16% | 0.29% | 0.05% | 0.01% |
| | T | 0.02% | 0.01% | 0.04% | 0.01% |

| HEK3 pNMG-361 | | 6 A | 8 A | 12 A | 15 A |
|---|---|---|---|---|---|
| | A | 99.87% | 99.43% | 99.97% | 99.98% |
| | C | 0.01% | 0.00% | 0.00% | 0.01% |
| | G | 0.11% | 0.55% | 0.02% | 0.00% |
| | T | 0.02% | 0.01% | 0.00% | 0.01% |

| HEK3 pNMG-362 | | 6 A | 8 A | 12 A | 15 A |
|---|---|---|---|---|---|
| | A | 99.52% | 97.90% | 99.96% | 99.99% |
| | C | 0.00% | 0.00% | 0.01% | 0.00% |
| | G | 0.47% | 2.08% | 0.02% | 0.00% |
| | T | 0.01% | 0.01% | 0.01% | 0.01% |

| HEK3 pNMG-363 | | 6 A | 8 A | 12 A | 15 A |
|---|---|---|---|---|---|
| | A | 99.54% | 96.76% | 99.97% | 99.97% |
| | C | 0.00% | 0.00% | 0.00% | 0.02% |
| | G | 0.44% | 3.20% | 0.03% | 0.00% |
| | T | 0.01% | 0.01% | 0.00% | 0.01% |

| HEK3 pNMG-364 | | 6 A | 8 A | 12 A | 15 A |
|---|---|---|---|---|---|
| | A | 99.87% | 99.32% | 99.95% | 99.99% |
| | C | 0.00% | 0.00% | 0.00% | 0.00% |
| | G | 0.13% | 0.67% | 0.05% | 0.00% |
| | T | 0.00% | 0.01% | 0.00% | 0.00% |

| HEK3 pNMG-365 | | 6 A | 8 A | 12 A | 15 A |
|---|---|---|---|---|---|
| | A | 99.53% | 98.13% | 99.94% | 99.99% |
| | C | 0.01% | 0.01% | 0.00% | 0.01% |
| | G | 0.44% | 1.86% | 0.05% | 0.00% |
| | T | 0.02% | 0.00% | 0.00% | 0.00% |

| HEK3 366 | | 6 A | 8 A | 12 A | 15 A |
|---|---|---|---|---|---|
| | A | 99.16% | 97.43% | 99.97% | 99.99% |
| | C | 0.00% | 0.00% | 0.01% | 0.00% |
| | G | 0.84% | 2.56% | 0.02% | 0.00% |
| | T | 0.00% | 0.01% | 0.00% | 0.00% |

| HEK3 367 | | 6 A | 8 A | 12 A | 15 A |
|---|---|---|---|---|---|
| | A | 99.39% | 97.22% | 99.93% | 99.98% |
| | C | 0.01% | 0.01% | 0.01% | 0.01% |
| | G | 0.59% | 2.76% | 0.06% | 0.01% |
| | T | 0.01% | 0.01% | 0.01% | 0.01% |

| HEK3 pNMG-369 | | 6 A | 8 A | 12 A | 15 A |
|---|---|---|---|---|---|
| | A | 98.95% | 97.14% | 99.96% | 99.99% |
| | C | 0.00% | 0.00% | 0.00% | 0.00% |
| | G | 1.04% | 2.85% | 0.03% | 0.01% |
| | T | 0.00% | 0.01% | 0.00% | 0.01% |

| HEK3 pNMG-370 | | 6 A | 8 A | 12 A | 15 A |
|---|---|---|---|---|---|
| | A | 99.43% | 98.20% | 99.97% | 99.98% |
| | C | 0.00% | 0.01% | 0.00% | 0.01% |
| | G | 0.56% | 1.79% | 0.03% | 0.00% |
| | T | 0.00% | 0.01% | 0.00% | 0.01% |

| HEK3 pNMG-371 | | 6 A | 8 A | 12 A | 15 A |
|---|---|---|---|---|---|
| | A | 98.86% | 97.59% | 99.96% | 99.98% |
| | C | 0.00% | 0.00% | 0.01% | 0.00% |
| | G | 1.12% | 2.39% | 0.03% | 0.01% |
| | T | 0.01% | 0.01% | 0.00% | 0.01% |

FIGURE 114

FANCF-5'-GGA$_3$ATCCCTTCTGCA$_{15}$GCA$_{18}$CCTGG-3'

FIGURE 115

Hek-2 site: 3'-CCCGCAGT$_{16}$CT$_{14}$AT$_{12}$GCT$_9$T$_8$T$_7$G T$_5$GT$_3$ T$_2$C-5'

| HEK2 pNMG-370/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.02% | 0.00% | 0.01% | 0.00% | 0.04% | 0.01% | 0.00% |
| | C | 0.01% | 0.03% | 0.01% | 0.34% | 0.67% | 0.44% | | 1.20% | 0.10% |
| | G | 0.00% | 0.00% | 0.00% | 0.00% | 0.00% | 0.00% | 0.03% | 0.00% | 0.00% |
| | T | 99.98% | 99.96% | 99.97% | 99.65% | 99.32% | 99.56% | | 98.79% | 99.89% |

| HEK2 pNMG-371/299 | | 16 T | 14 T | 12 T | 9 T | 8 T | 7 T | 5 T | 3 T | 2 T |
|---|---|---|---|---|---|---|---|---|---|---|
| | A | 0.00% | 0.01% | 0.01% | 0.00% | 0.01% | 0.00% | 0.01% | 0.01% | 0.00% |
| | C | 0.01% | 0.02% | 0.05% | 0.73% | 1.26% | 1.46% | | 3.91% | 0.11% |
| | G | 0.01% | 0.00% | 0.00% | 0.00% | 0.01% | 0.00% | 0.01% | 0.00% | 0.00% |
| | T | 99.98% | 99.97% | 99.94% | 99.26% | 98.73% | 98.53% | | 96.07% | 99.89% |

| HEK2 pNMG-382/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.00% | 0.00% | 0.00% |
| | C | 0.01% | 0.01% | 0.03% | 0.02% | 0.23% | 0.31% | | 0.55% | 0.06% |
| | G | 0.01% | 0.00% | 0.00% | 0.00% | 0.00% | 0.00% | 0.02% | 0.00% | 0.00% |
| | T | 99.97% | 99.98% | 99.96% | 99.98% | 99.76% | 99.69% | | 99.45% | 99.93% |

| HEK2 pNMG-383/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.02% | 0.01% | 0.00% |
| | C | 0.01% | 0.02% | 0.02% | 0.10% | 0.07% | 0.13% | | 0.29% | 0.05% |
| | G | 0.01% | 0.00% | 0.00% | 0.00% | 0.01% | 0.00% | 0.01% | 0.00% | 0.00% |
| | T | 99.98% | 99.98% | 99.97% | 99.89% | 99.91% | 99.87% | | 99.69% | 99.94% |

| HEK2 pNMG-384/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.00% | 0.00% | 0.01% | 0.00% | 0.01% | 0.00% | 0.01% |
| | C | 0.02% | 0.03% | 0.03% | 0.04% | 0.05% | 0.11% | | 0.12% | 0.03% |
| | G | 0.01% | 0.00% | 0.00% | 0.00% | 0.00% | 0.00% | 0.00% | 0.00% | 0.00% |
| | T | 99.97% | 99.97% | 99.97% | 99.95% | 99.94% | 99.89% | | 99.88% | 99.97% |

| HEK2 pNMG-385/299 | | 16 T | 14 T | 12 T | 9 T | 8 T | 7 T | 5 T | 3 T | 2 T |
|---|---|---|---|---|---|---|---|---|---|---|
| | A | 0.00% | 0.01% | 0.01% | 0.00% | 0.01% | 0.00% | 0.01% | 0.00% | 0.00% |
| | C | 0.01% | 0.02% | 0.02% | 0.01% | 0.06% | 0.09% | | 0.12% | 0.05% |
| | G | 0.01% | 0.00% | 0.00% | 0.00% | 0.01% | 0.00% | 0.01% | 0.00% | 0.00% |
| | T | 99.99% | 99.98% | 99.98% | 99.99% | 99.92% | 99.91% | | 99.68% | 99.95% |

| HEK2 pNMG-386/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.01% | 0.00% | 0.00% |
| | C | 0.01% | 0.02% | 0.01% | 0.07% | 0.44% | 0.13% | | 0.80% | 0.04% |
| | G | 0.01% | 0.00% | 0.00% | 0.00% | 0.01% | 0.00% | 0.01% | 0.00% | 0.00% |
| | T | 99.97% | 99.98% | 99.98% | 99.93% | 99.54% | 99.87% | | 99.20% | 99.96% |

FIGURE 115 (Continued)

Hek-2 site: 3'-CCCGCAGT$_{16}$CT$_{14}$AT$_{12}$GCT$_9$T$_8$T$_7$G T$_5$GT$_3$T$_2$C-5'

| HEK2 pNMG-387/299 | | 16<br>T | 14<br>T | 12<br>T | 9<br>T | 8<br>T | 7<br>T | 5<br>T | 3<br>T | 2<br>T |
|---|---|---|---|---|---|---|---|---|---|---|
| | A | 0.00% | 0.00% | 0.01% | 0.00% | 0.02% | 0.00% | 0.01% | 0.00% | 0.00% |
| | C | 0.01% | 0.02% | 0.02% | 0.05% | 0.18% | 0.13% | — | 0.63% | 0.02% |
| | G | 0.00% | 0.00% | 0.00% | 0.00% | 0.01% | 0.00% | 0.01% | 0.00% | 0.00% |
| | T | 99.98% | 99.97% | 99.97% | 99.94% | 99.79% | 99.86% | — | 99.37% | 99.98% |

| HEK2 pNMG-388/299 | | 16<br>T | 14<br>T | 12<br>T | 9<br>T | 8<br>T | 7<br>T | 5<br>T | 3<br>T | 2<br>T |
|---|---|---|---|---|---|---|---|---|---|---|
| | A | 0.00% | 0.00% | 0.01% | 0.00% | 0.00% | 0.00% | 0.01% | 0.00% | 0.00% |
| | C | 0.01% | 0.02% | 0.01% | 0.04% | 0.18% | 0.13% | — | 0.55% | 0.07% |
| | G | 0.00% | 0.00% | 0.00% | 0.00% | 0.01% | 0.00% | 0.01% | 0.00% | 0.00% |
| | T | 99.99% | 99.97% | 99.98% | 99.95% | 99.81% | 99.87% | — | 99.44% | 99.93% |

| HEK2 pNMG-389/299 | | 16<br>T | 14<br>T | 12<br>T | 9<br>T | 8<br>T | 7<br>T | 5<br>T | 3<br>T | 2<br>T |
|---|---|---|---|---|---|---|---|---|---|---|
| | A | 0.00% | 0.00% | 0.00% | 0.01% | 0.02% | 0.00% | 0.02% | 0.00% | 0.00% |
| | C | 0.02% | 0.01% | 0.01% | 0.09% | 0.19% | 0.22% | — | 0.40% | 0.07% |
| | G | 0.00% | 0.00% | 0.00% | 0.00% | 0.00% | 0.01% | 0.01% | 0.00% | 0.00% |
| | T | 99.98% | 99.98% | 99.99% | 99.89% | 99.79% | 99.77% | — | 99.60% | 99.92% |

| HEK2 pNMG-370/301 | | 16<br>T | 14<br>T | 12<br>T | 9<br>T | 8<br>T | 7<br>T | 5<br>T | 3<br>T | 2<br>T |
|---|---|---|---|---|---|---|---|---|---|---|
| | A | 0.00% | 0.00% | 0.01% | 0.00% | 0.01% | 0.01% | 0.03% | 0.01% | 0.01% |
| | C | 0.01% | 0.02% | 0.01% | 0.90% | 10.56% | 1.26% | — | — | 0.73% |
| | G | 0.01% | 0.00% | 0.00% | 0.00% | 0.05% | 0.00% | 0.00% | 0.00% | 0.00% |
| | T | 99.98% | 99.97% | 99.98% | 99.09% | 89.38% | 98.73% | — | — | 99.26% |

| HEK2 pNMG-371/301 | | 16<br>T | 14<br>T | 12<br>T | 9<br>T | 8<br>T | 7<br>T | 5<br>T | 3<br>T | 2<br>T |
|---|---|---|---|---|---|---|---|---|---|---|
| | A | 0.00% | 0.00% | 0.01% | 0.00% | 0.05% | 0.02% | 0.02% | 0.03% | 0.00% |
| | C | 0.01% | 0.02% | 0.04% | 1.52% | 13.25% | 4.44% | — | — | 1.66% |
| | G | 0.01% | 0.00% | 0.00% | 0.00% | 0.03% | 0.00% | 0.03% | 0.00% | 0.00% |
| | T | 99.98% | 99.98% | 99.95% | 98.48% | 86.67% | 95.54% | — | — | 98.33% |

| HEK2 pNMG-382/301 | | 16<br>T | 14<br>T | 12<br>T | 9<br>T | 8<br>T | 7<br>T | 5<br>T | 3<br>T | 2<br>T |
|---|---|---|---|---|---|---|---|---|---|---|
| | A | 0.00% | 0.01% | 0.01% | 0.00% | 0.01% | 0.00% | 0.00% | 0.00% | 0.00% |
| | C | 0.01% | 0.01% | 0.02% | 0.13% | 6.00% | 0.73% | — | 12.15% | 0.80% |
| | G | 0.01% | 0.00% | 0.00% | 0.00% | 0.05% | 0.00% | 0.00% | 0.03% | 0.00% |
| | T | 99.98% | 99.98% | 99.97% | 99.87% | 93.94% | 99.27% | — | 87.82% | 99.20% |

| HEK2 pNMG-383/301 | | 16<br>T | 14<br>T | 12<br>T | 9<br>T | 8<br>T | 7<br>T | 5<br>T | 3<br>T | 2<br>T |
|---|---|---|---|---|---|---|---|---|---|---|
| | A | 0.00% | 0.00% | 0.01% | 0.00% | 0.01% | 0.01% | 0.01% | 0.01% | 0.00% |
| | C | 0.01% | 0.02% | 0.01% | 0.51% | 3.02% | 0.62% | — | 10.65% | 0.30% |
| | G | 0.00% | 0.00% | 0.00% | 0.00% | 0.01% | 0.00% | 0.00% | 0.00% | 0.00% |
| | T | 99.99% | 99.98% | 99.98% | 99.49% | 96.97% | 99.37% | — | 89.34% | 99.69% |

FIGURE 115 (Continued)

Hek-2 site: 3'-CCCGCAGT$_{16}$CT$_{14}$AT$_{12}$GCT$_9$T$_8$T$_7$G T$_5$ GT$_3$ T$_2$C-5'

| HEK2 pNMG-384/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.02% | 0.01% | 0.00% | 0.00% | 0.01% | 0.00% | 0.00% |
| | C | 0.01% | 0.02% | 0.01% | 0.42% | 2.72% | 0.18% | 13.40% | 6.88% | 0.12% |
| | G | 0.01% | 0.00% | 0.00% | 0.00% | 0.03% | 0.00% | 0.00% | 0.00% | 0.00% |
| | T | 99.98% | 99.98% | 99.97% | 99.58% | 97.25% | 99.82% | 86.59% | 93.11% | 99.87% |

| HEK2 pNMG-385/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.00% | 0.00% | 0.01% | 0.00% | 0.00% | 0.00% | 0.01% |
| | C | 0.00% | 0.02% | 0.01% | 0.06% | 0.43% | 0.06% | 8.73% | 2.84% | 0.11% |
| | G | 0.01% | 0.00% | 0.00% | 0.00% | 0.01% | 0.00% | 0.00% | 0.00% | 0.00% |
| | T | 99.99% | 99.98% | 99.98% | 99.93% | 99.56% | 99.94% | 91.27% | 97.16% | 99.88% |

| HEK2 pNMG-386/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.01% | 0.00% | 0.00% |
| | C | 0.01% | 0.02% | 0.01% | 0.64% | 2.94% | 0.28% | 15.51% | 7.73% | 0.23% |
| | G | 0.05% | 0.00% | 0.00% | 0.00% | 0.01% | 0.00% | 0.00% | 0.01% | 0.00% |
| | T | 99.94% | 99.98% | 99.98% | 99.35% | 97.04% | 99.72% | 84.48% | 92.26% | 99.76% |

| HEK2 pNMG-387/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.01% | 0.00% | 0.00% |
| | C | 0.01% | 0.01% | 0.04% | 0.13% | 3.90% | 0.44% | 15.03% | 10.22% | 0.57% |
| | G | 0.00% | 0.00% | 0.00% | 0.00% | 0.01% | 0.00% | 0.01% | 0.00% | 0.00% |
| | T | 99.99% | 99.98% | 99.95% | 99.86% | 96.08% | 99.56% | 84.96% | 89.78% | 99.43% |

| HEK2 pNMG-388/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.00% | 0.00% | 0.01% | 0.00% | 0.01% | 0.00% | 0.01% |
| | C | 0.00% | 0.01% | 0.02% | 0.12% | 4.98% | 0.61% | 19.00% | 12.33% | 0.70% |
| | G | 0.00% | 0.00% | 0.00% | 0.00% | 0.01% | 0.00% | 0.00% | 0.00% | 0.00% |
| | T | 99.99% | 99.98% | 99.97% | 99.88% | 95.00% | 99.39% | 80.99% | 87.67% | 99.29% |

| HEK2 pNMG-389/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.02% | 0.01% | 0.01% | 0.01% | 0.01% |
| | C | 0.01% | 0.02% | 0.01% | 0.27% | 9.85% | 0.60% | 17.48% | 9.82% | 0.86% |
| | G | 0.01% | 0.00% | 0.00% | 0.00% | 0.01% | 0.01% | 0.00% | 0.00% | 0.00% |
| | T | 99.98% | 99.98% | 99.98% | 99.73% | 90.07% | 99.39% | 82.50% | 90.17% | 99.13% |

FIGURE 116

Hek2-2 site: 5'-GA$_2$A$_3$TA$_5$CTA$_9$A$_9$GCA$_{12}$TA$_{14}$GA$_{16}$CTCCAGG-3'

| HEK2-2 pNMG-370 | | 2<br>A | 3<br>A | 5<br>A | 8<br>A | 9<br>A | 12<br>A | 14<br>A | 16<br>A |
|---|---|---|---|---|---|---|---|---|---|
| | A | 99.81% | 99.80% | | 99.53% | 99.93% | 99.97% | 99.99% | 99.99% |
| | C | 0.02% | 0.01% | 0.01% | 0.01% | 0.01% | 0.01% | 0.01% | 0.00% |
| | G | 0.14% | 0.19% | | 0.46% | 0.06% | 0.01% | 0.00% | 0.01% |
| | T | 0.02% | 0.01% | 0.01% | 0.00% | 0.00% | 0.01% | 0.01% | 0.00% |

| HEK2-2 pNMG-371 | | 2<br>A | 3<br>A | 5<br>A | 8<br>A | 9<br>A | 12<br>A | 14<br>A | 16<br>A |
|---|---|---|---|---|---|---|---|---|---|
| | A | 99.47% | 99.28% | | 99.33% | 99.65% | 99.98% | 99.99% | 100.00% |
| | C | 0.02% | 0.00% | 0.00% | 0.00% | 0.00% | 0.00% | 0.00% | 0.00% |
| | G | 0.50% | 0.71% | | 0.66% | 0.35% | 0.01% | 0.01% | 0.00% |
| | T | 0.01% | 0.01% | 0.01% | 0.00% | 0.00% | 0.01% | 0.00% | 0.00% |

| HEK2-2 pNMG-382 | | 2<br>A | 3<br>A | 5<br>A | 8<br>A | 9<br>A | 12<br>A | 14<br>A | 16<br>A |
|---|---|---|---|---|---|---|---|---|---|
| | A | 99.91% | 99.88% | | 99.85% | 99.97% | 99.97% | 99.95% | 99.97% |
| | C | 0.03% | 0.01% | 0.01% | 0.03% | 0.02% | 0.02% | 0.04% | 0.01% |
| | G | 0.05% | 0.10% | | 0.12% | 0.01% | 0.01% | 0.01% | 0.00% |
| | T | 0.01% | 0.00% | 0.01% | 0.00% | 0.01% | 0.00% | 0.00% | 0.02% |

| HEK2-2 pNMG-383 | | 2<br>A | 3<br>A | 5<br>A | 8<br>A | 9<br>A | 12<br>A | 14<br>A | 16<br>A |
|---|---|---|---|---|---|---|---|---|---|
| | A | 99.91% | 99.97% | | 99.93% | 99.95% | 99.98% | 99.99% | 99.98% |
| | C | 0.01% | 0.00% | 0.00% | 0.00% | 0.00% | 0.00% | 0.00% | 0.00% |
| | G | 0.07% | 0.03% | | 0.07% | 0.04% | 0.01% | 0.01% | 0.01% |
| | T | 0.00% | 0.00% | 0.01% | 0.00% | 0.00% | 0.01% | 0.01% | 0.00% |

| HEK2-2 pNMG-384 | | 2<br>A | 3<br>A | 5<br>A | 8<br>A | 9<br>A | 12<br>A | 14<br>A | 16<br>A |
|---|---|---|---|---|---|---|---|---|---|
| | A | 99.92% | 99.99% | | 99.96% | 99.95% | 99.97% | 99.97% | 99.99% |
| | C | 0.02% | 0.01% | 0.01% | 0.01% | 0.01% | 0.01% | 0.01% | 0.01% |
| | G | 0.05% | 0.00% | | 0.03% | 0.04% | 0.01% | 0.01% | 0.00% |
| | T | 0.01% | 0.00% | 0.01% | 0.00% | 0.00% | 0.01% | 0.00% | 0.00% |

FIGURE 116 (Continued)

Hek2-2 site: 5'-GA$_2$A$_3$TA$_5$CTA$_8$A$_9$GCA$_{12}$TA$_{14}$GA$_{16}$CTCCAGG-3'

| HEK2-2 pNMG-385 | | 2 A | 3 A | 5 A | 8 A | 9 A | 12 A | 14 A | 16 A |
|---|---|---|---|---|---|---|---|---|---|
| | A | 99.95% | 99.99% | 88.71% | 99.96% | 99.99% | 99.99% | 99.99% | 99.99% |
| | C | 0.01% | 0.00% | 0.00% | 0.00% | 0.00% | 0.00% | 0.00% | 0.00% |
| | G | 0.04% | 0.01% | 11.29% | 0.03% | 0.01% | 0.00% | 0.01% | 0.00% |
| | T | 0.00% | 0.00% | 0.01% | 0.00% | 0.00% | 0.00% | 0.00% | 0.00% |

| HEK2-2 pNMG-386 | | 2 A | 3 A | 5 A | 8 A | 9 A | 12 A | 14 A | 16 A |
|---|---|---|---|---|---|---|---|---|---|
| | A | 99.92% | 99.95% | 79.42% | 99.88% | 99.96% | 99.95% | 99.97% | 99.98% |
| | C | 0.04% | 0.02% | 0.02% | 0.04% | 0.03% | 0.04% | 0.02% | 0.02% |
| | G | 0.03% | 0.02% | 20.54% | 0.08% | 0.00% | 0.00% | 0.01% | 0.00% |
| | T | 0.01% | 0.01% | 0.01% | 0.00% | 0.00% | 0.01% | 0.00% | 0.00% |

| HEK2-2 pNMG-387 | | 2 A | 3 A | 5 A | 8 A | 9 A | 12 A | 14 A | 16 A |
|---|---|---|---|---|---|---|---|---|---|
| | A | 99.86% | 99.93% | 78.43% | 99.82% | 99.94% | 99.98% | 99.99% | 99.99% |
| | C | 0.02% | 0.00% | 0.00% | 0.00% | 0.00% | 0.00% | 0.00% | 0.00% |
| | G | 0.11% | 0.06% | 21.56% | 0.17% | 0.05% | 0.01% | 0.01% | 0.01% |
| | T | 0.00% | 0.00% | 0.01% | 0.00% | 0.01% | 0.01% | 0.00% | 0.01% |

| HEK2-2 pNMG-388 | | 2 A | 3 A | 5 A | 8 A | 9 A | 12 A | 14 A | 16 A |
|---|---|---|---|---|---|---|---|---|---|
| | A | 99.87% | 99.88% | 76.34% | 99.90% | 99.98% | 99.98% | 99.98% | 99.98% |
| | C | 0.01% | 0.00% | 0.01% | 0.00% | 0.00% | 0.00% | 0.02% | 0.00% |
| | G | 0.12% | 0.12% | 23.64% | 0.09% | 0.01% | 0.01% | 0.00% | 0.00% |
| | T | 0.01% | 0.00% | 0.01% | 0.00% | 0.01% | 0.01% | 0.00% | 0.02% |

| HEK2-2 pNMG-389 | | 2 A | 3 A | 5 A | 8 A | 9 A | 12 A | 14 A | 16 A |
|---|---|---|---|---|---|---|---|---|---|
| | A | 99.82% | 99.95% | 76.62% | 99.90% | 99.97% | 99.99% | 99.98% | 99.99% |
| | C | 0.01% | 0.00% | 0.00% | 0.00% | 0.00% | 0.00% | 0.00% | 0.00% |
| | G | 0.16% | 0.04% | 23.37% | 0.10% | 0.02% | 0.01% | 0.01% | 0.00% |
| | T | 0.00% | 0.01% | 0.01% | 0.00% | 0.00% | 0.01% | 0.00% | 0.01% |

FIGURE 117

Hek 2-3 site: 5'-GTA$_3$A$_4$A$_5$CA$_7$A$_8$A$_9$GCA$_{12}$TA$_{14}$GA$_{16}$CTGAGGG -3'

| HEK2-3 pNMG-370 | | 3 A | 4 A | 5 A | 7 A | 8 A | 9 A | 12 A | 14 A | 16 A |
|---|---|---|---|---|---|---|---|---|---|---|
| | A | 99.86% | 99.81% | 99.59% | 99.89% | 99.50% | 99.67% | 99.97% | 99.97% | 99.99% |
| | C | 0.00% | 0.01% | 0.01% | 0.01% | 0.01% | 0.14% | 0.01% | 0.02% | 0.00% |
| | G | 0.12% | 0.17% | 10.39% | 0.10% | 0.48% | 0.19% | 0.02% | 0.01% | 0.00% |
| | T | 0.01% | 0.01% | 0.01% | 0.01% | 0.01% | 0.00% | 0.01% | 0.00% | 0.01% |

| HEK2-3 pNMG-371 | | 3 A | 4 A | 5 A | 7 A | 8 A | 9 A | 12 A | 14 A | 16 A |
|---|---|---|---|---|---|---|---|---|---|---|
| | A | 99.61% | 98.90% | 99.22% | 99.00% | 98.38% | 99.18% | 99.94% | 99.97% | 99.99% |
| | C | 0.00% | 0.01% | 0.00% | 0.00% | 0.00% | 0.13% | 0.00% | 0.01% | 0.00% |
| | G | 0.39% | 1.08% | | 1.00% | 1.60% | 0.69% | 0.04% | 0.02% | 0.00% |
| | T | 0.00% | 0.01% | 0.01% | 0.00% | 0.01% | 0.00% | 0.02% | 0.00% | 0.01% |

| HEK2-3 pNMG-382 | | 3 A | 4 A | 5 A | 7 A | 8 A | 9 A | 12 A | 14 A | 16 A |
|---|---|---|---|---|---|---|---|---|---|---|
| | A | 0.00% | 0.00% | 0.01% | 0.00% | 0.01% | 0.00% | 0.00% | 0.00% | 0.00% |
| | C | 0.01% | 0.01% | 0.03% | 0.02% | 0.23% | 0.31% | | 0.55% | 0.06% |
| | G | 0.01% | 0.00% | 0.00% | 0.00% | 0.00% | 0.00% | 0.02% | 0.00% | 0.00% |
| | T | 99.97% | 99.98% | 99.96% | 99.98% | 99.76% | 99.69% | | 99.45% | 99.93% |

| HEK2-3 pNMG-383 | | 3 A | 4 A | 5 A | 7 A | 8 A | 9 A | 12 A | 14 A | 16 A |
|---|---|---|---|---|---|---|---|---|---|---|
| | A | 0.00% | 0.00% | 0.01% | 0.00% | 0.01% | 0.00% | 0.02% | 0.01% | 0.00% |
| | C | 0.01% | 0.02% | 0.02% | 0.10% | 0.07% | 0.13% | | 0.29% | 0.05% |
| | G | 0.01% | 0.00% | 0.00% | 0.00% | 0.01% | 0.00% | 0.01% | 0.00% | 0.00% |
| | T | 99.98% | 99.98% | 99.97% | 99.89% | 99.91% | 99.87% | 47.13% | 99.69% | 99.94% |

| HEK2-3 pNMG-384 | | 3 A | 4 A | 5 A | 7 A | 8 A | 9 A | 12 A | 14 A | 16 A |
|---|---|---|---|---|---|---|---|---|---|---|
| | A | 0.00% | 0.00% | 0.00% | 0.00% | 0.01% | 0.00% | 0.01% | 0.00% | 0.01% |
| | C | 0.02% | 0.03% | 0.03% | 0.04% | 0.05% | 0.11% | | 0.12% | 0.03% |
| | G | 0.01% | 0.00% | 0.00% | 0.00% | 0.00% | 0.00% | 0.00% | 0.00% | 0.00% |
| | T | 99.97% | 99.97% | 99.97% | 99.95% | 99.94% | 99.88% | | 99.88% | 99.97% |

| HEK2-3 pNMG-385 | | 3 A | 4 A | 5 A | 7 A | 8 A | 9 A | 12 A | 14 A | 16 A |
|---|---|---|---|---|---|---|---|---|---|---|
| | A | 0.00% | 0.01% | 0.01% | 0.00% | 0.01% | 0.00% | 0.01% | 0.00% | 0.00% |
| | C | 0.01% | 0.02% | 0.02% | 0.01% | 0.06% | 0.09% | | 0.12% | 0.05% |
| | G | 0.01% | 0.00% | 0.00% | 0.00% | 0.01% | 0.00% | 0.01% | 0.00% | 0.00% |
| | T | 99.99% | 99.98% | 99.98% | 99.99% | 99.92% | 99.91% | | 99.88% | 99.95% |

FIGURE 117 (Continued)

Hek 2-3 site: 5'-GTA$_3$A$_4$A$_5$CA$_7$A$_8$A$_9$GCA$_{12}$TA$_{14}$GA$_{16}$CTGAGGG -3'

| HEK2-3 pNMG-386 | | 3 A | 4 A | 5 A | 7 A | 8 A | 9 A | 12 A | 14 A | 16 A |
|---|---|---|---|---|---|---|---|---|---|---|
| | A | 0.00% | 0.00% | 0.01% | 0.00% | 0.01% | 0.00% | 0.01% | 0.00% | 0.00% |
| | C | 0.01% | 0.02% | 0.01% | 0.07% | 0.44% | 0.13% | ▓▓▓ | 0.80% | 0.04% |
| | G | 0.01% | 0.00% | 0.00% | 0.00% | 0.01% | 0.00% | 0.01% | 0.00% | 0.00% |
| | T | 99.97% | 99.98% | 99.98% | 99.93% | 99.54% | 99.87% | ▓▓▓ | 99.20% | 99.96% |

| HEK2-3 pNMG-387 | | 3 A | 4 A | 5 A | 7 A | 8 A | 9 A | 12 A | 14 A | 16 A |
|---|---|---|---|---|---|---|---|---|---|---|
| | A | 0.00% | 0.00% | 0.01% | 0.00% | 0.02% | 0.00% | 0.01% | 0.00% | 0.00% |
| | C | 0.01% | 0.02% | 0.02% | 0.05% | 0.18% | 0.13% | ▓▓▓ | 0.63% | 0.02% |
| | G | 0.00% | 0.00% | 0.00% | 0.00% | 0.01% | 0.00% | 0.01% | 0.00% | 0.00% |
| | T | 99.98% | 99.97% | 99.97% | 99.94% | 99.79% | 99.86% | ▓▓▓ | 99.37% | 99.98% |

| HEK2-3 pNMG-388 | | 3 A | 4 A | 5 A | 7 A | 8 A | 9 A | 12 A | 14 A | 16 A |
|---|---|---|---|---|---|---|---|---|---|---|
| | A | 0.00% | 0.00% | 0.01% | 0.00% | 0.00% | 0.00% | 0.01% | 0.00% | 0.00% |
| | C | 0.01% | 0.02% | 0.01% | 0.04% | 0.18% | 0.13% | ▓▓▓ | 0.55% | 0.07% |
| | G | 0.00% | 0.00% | 0.00% | 0.00% | 0.01% | 0.00% | 0.01% | 0.00% | 0.00% |
| | T | 99.99% | 99.97% | 99.98% | 99.95% | 99.81% | 99.87% | ▓▓▓ | 99.44% | 99.93% |

| HEK2-3 pNMG-389 | | 3 A | 4 A | 5 A | 7 A | 8 A | 9 A | 12 A | 14 A | 16 A |
|---|---|---|---|---|---|---|---|---|---|---|
| | A | 0.00% | 0.00% | 0.00% | 0.01% | 0.02% | 0.00% | 0.02% | 0.00% | 0.00% |
| | C | 0.02% | 0.01% | 0.01% | 0.09% | 0.19% | 0.22% | ▓▓▓ | 0.40% | 0.07% |
| | G | 0.00% | 0.00% | 0.00% | 0.00% | 0.00% | 0.01% | 0.01% | 0.00% | 0.00% |
| | T | 99.98% | 99.98% | 99.99% | 99.89% | 99.79% | 99.77% | ▓▓▓ | 99.60% | 99.92% |

FIGURE 118

HEK2-6- 5'-GA$_2$A$_3$GA$_5$CCA$_8$A$_9$GGA$_{12}$TA$_{14}$GA$_{16}$CTGCTGG-3'

| HEK2-6 pNMG-370 | | 2 A | 3 A | 5 A | 8 A | 9 A | 12 A | 14 A | 16 A |
|---|---|---|---|---|---|---|---|---|---|
| | A | 99.96% | 99.94% | 95.58% | 99.77% | 99.84% | 99.96% | 99.98% | 99.97% |
| | C | 0.00% | 0.01% | 0.01% | 0.01% | 0.01% | 0.01% | 0.00% | 0.02% |
| | G | 0.03% | 0.04% | 4.40% | 0.21% | 0.14% | 0.02% | 0.02% | 0.01% |
| | T | 0.01% | 0.01% | 0.01% | 0.01% | 0.02% | 0.01% | 0.01% | 0.01% |

| HEK2-6 pNMG-371 | | 2 A | 3 A | 5 A | 8 A | 9 A | 12 A | 14 A | 16 A |
|---|---|---|---|---|---|---|---|---|---|
| | A | 99.95% | 99.91% | 92.37% | 99.60% | 99.63% | 99.98% | 99.99% | 99.99% |
| | C | 0.00% | 0.00% | 0.00% | 0.00% | 0.00% | 0.00% | 0.00% | 0.01% |
| | G | 0.04% | 0.08% | 7.61% | 0.39% | 0.35% | 0.01% | 0.01% | 0.00% |
| | T | 0.01% | 0.01% | 0.02% | 0.01% | 0.01% | 0.00% | 0.01% | 0.00% |

| HEK2-6 pNMG-382 | | 2 A | 3 A | 5 A | 8 A | 9 A | 12 A | 14 A | 16 A |
|---|---|---|---|---|---|---|---|---|---|
| | A | 99.97% | 99.97% | 95.39% | 99.88% | 99.90% | 99.99% | 99.99% | 99.96% |
| | C | 0.00% | 0.01% | 0.01% | 0.01% | 0.01% | 0.00% | 0.00% | 0.01% |
| | G | 0.03% | 0.01% | 4.59% | 0.10% | 0.08% | 0.01% | 0.00% | 0.02% |
| | T | 0.01% | 0.01% | 0.01% | 0.01% | 0.01% | 0.00% | 0.01% | 0.01% |

| HEK2-6 pNMG-383 | | 2 A | 3 A | 5 A | 8 A | 9 A | 12 A | 14 A | 16 A |
|---|---|---|---|---|---|---|---|---|---|
| | A | 99.97% | 99.97% | 94.48% | 99.97% | 99.90% | 99.94% | 99.97% | 99.98% |
| | C | 0.00% | 0.01% | 0.00% | 0.00% | 0.01% | 0.00% | 0.01% | 0.01% |
| | G | 0.02% | 0.01% | 5.50% | 0.03% | 0.07% | 0.04% | 0.01% | 0.00% |
| | T | 0.00% | 0.01% | 0.02% | 0.00% | 0.02% | 0.01% | 0.01% | 0.01% |

| HEK2-6 pNMG-384 | | 2 A | 3 A | 5 A | 8 A | 9 A | 12 A | 14 A | 16 A |
|---|---|---|---|---|---|---|---|---|---|
| | A | 99.96% | 99.97% | 97.20% | 99.98% | 99.94% | 99.97% | 99.98% | 99.97% |
| | C | 0.00% | 0.01% | 0.00% | 0.00% | 0.01% | 0.01% | 0.00% | 0.01% |
| | G | 0.03% | 0.01% | 2.79% | 0.01% | 0.04% | 0.01% | 0.01% | 0.01% |
| | T | 0.00% | 0.01% | 0.01% | 0.00% | 0.02% | 0.01% | 0.01% | 0.00% |

FIGURE 118 (Continued)

HEK2-6- 5'-GA$_2$A$_3$GA$_5$CCA$_8$A$_9$GGA$_{12}$TA$_{14}$GA$_{16}$CTGCTGG-3'

| HEK2-6 pNMG-385 | | 2 A | 3 A | 5 A | 8 A | 9 A | 12 A | 14 A | 16 A |
|---|---|---|---|---|---|---|---|---|---|
| | A | 99.96% | 99.97% | 98.54% | 99.98% | 99.97% | 99.97% | 99.95% | 99.98% |
| | C | 0.00% | 0.01% | 0.01% | 0.00% | 0.01% | 0.00% | 0.01% | 0.00% |
| | G | 0.02% | 0.01% | 1.45% | 0.01% | 0.02% | 0.01% | 0.03% | 0.01% |
| | T | 0.01% | 0.01% | 0.01% | 0.01% | 0.00% | 0.02% | 0.01% | 0.01% |

| HEK2-6 pNMG-386 | | 2 A | 3 A | 5 A | 8 A | 9 A | 12 A | 14 A | 16 A |
|---|---|---|---|---|---|---|---|---|---|
| | A | 99.98% | 99.97% | 97.56% | 99.95% | 99.93% | 99.95% | 99.96% | 99.97% |
| | C | 0.01% | 0.01% | 0.01% | 0.02% | 0.02% | 0.01% | 0.01% | 0.02% |
| | G | 0.01% | 0.01% | 2.41% | 0.02% | 0.04% | 0.03% | 0.02% | 0.00% |
| | T | 0.00% | 0.01% | 0.01% | 0.01% | 0.01% | 0.00% | 0.02% | 0.00% |

| HEK2-6 pNMG-387 | | 2 A | 3 A | 5 A | 8 A | 9 A | 12 A | 14 A | 16 A |
|---|---|---|---|---|---|---|---|---|---|
| | A | 99.93% | 99.97% | 97.46% | 99.94% | 99.97% | 99.98% | 99.97% | 99.98% |
| | C | 0.01% | 0.01% | 0.00% | 0.01% | 0.01% | 0.00% | 0.00% | 0.01% |
| | G | 0.05% | 0.01% | 2.53% | 0.05% | 0.02% | 0.01% | 0.01% | 0.01% |
| | T | 0.01% | 0.01% | 0.01% | 0.00% | 0.01% | 0.01% | 0.01% | 0.00% |

| HEK2-6 pNMG-388 | | 2 A | 3 A | 5 A | 8 A | 9 A | 12 A | 14 A | 16 A |
|---|---|---|---|---|---|---|---|---|---|
| | A | 99.97% | 99.98% | 96.81% | 99.94% | 99.90% | 99.94% | 99.99% | 99.99% |
| | C | 0.00% | 0.01% | 0.01% | 0.00% | 0.00% | 0.00% | 0.00% | 0.00% |
| | G | 0.02% | 0.01% | 3.18% | 0.06% | 0.08% | 0.06% | 0.00% | 0.00% |
| | T | 0.01% | 0.01% | 0.00% | 0.00% | 0.01% | 0.01% | 0.01% | 0.00% |

| HEK2-6 pNMG-389 | | 2 A | 3 A | 5 A | 8 A | 9 A | 12 A | 14 A | 16 A |
|---|---|---|---|---|---|---|---|---|---|
| | A | 99.97% | 99.96% | 97.46% | 99.97% | 99.85% | 99.89% | 99.97% | 99.97% |
| | C | 0.00% | 0.01% | 0.00% | 0.00% | 0.02% | 0.00% | 0.00% | 0.02% |
| | G | 0.02% | 0.02% | 2.51% | 0.03% | 0.13% | 0.10% | 0.01% | 0.01% |
| | T | 0.01% | 0.02% | 0.03% | 0.00% | 0.01% | 0.01% | 0.02% | 0.00% |

FIGURE 119

HEK2-7- 3'-CCTGCAGT$_{16}$ CAAT$_{12}$ GAT$_9$T$_8$T$_7$GT$_5$T$_4$T$_3$T$_2$G-5'

| HEK2-7 pNMG-370 |   | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.01% | 0.01% | 0.01% | 0.00% | 0.00% | 0.01% |
| | C | 0.02% | 0.01% | 0.04% | 0.02% | 0.01% | 0.30% | 0.01% | 0.01% | 0.01% |
| | G | 0.00% | 0.00% | 0.00% | 0.00% | 0.00% | 0.00% | 0.00% | 0.00% | 0.00% |
| | T | 99.98% | 99.99% | 99.96% | 99.98% | 99.99% | 99.69% | 99.99% | 99.99% | 99.99% |

| HEK2-7 pNMG-371 |   | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.00% | 0.00% | 0.00% | 0.00% | 0.00% |
| | C | 0.02% | 0.01% | 0.07% | 0.05% | 0.05% | 0.75% | 0.04% | 0.02% | 0.01% |
| | G | 0.00% | 0.00% | 0.00% | 0.00% | 0.00% | 0.00% | 0.00% | 0.00% | 0.00% |
| | T | 99.98% | 99.98% | 99.92% | 99.95% | 99.94% | 99.24% | 99.96% | 99.98% | 99.99% |

| HEK2-7 pNMG-382 |   | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.01% | 0.01% | 0.00% | 0.00% | 0.00% |
| | C | 0.01% | 0.01% | 0.01% | 0.01% | 0.00% | 0.26% | 0.01% | 0.01% | 0.01% |
| | G | 0.00% | 0.00% | 0.00% | 0.00% | 0.00% | 0.00% | 0.00% | 0.00% | 0.00% |
| | T | 99.99% | 99.98% | 99.99% | 99.99% | 99.99% | 99.74% | 99.99% | 99.99% | 99.98% |

| HEK2-7 pNMG-383 |   | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.00% | 0.01% | 0.00% | 0.00% | 0.00% |
| | C | 0.01% | 0.01% | 0.01% | 0.02% | 0.01% | 0.23% | 0.01% | 0.01% | 0.00% |
| | G | 0.00% | 0.01% | 0.00% | 0.00% | 0.00% | 0.01% | 0.00% | 0.00% | 0.00% |
| | T | 99.99% | 99.98% | 99.99% | 99.98% | 99.99% | 99.76% | 99.99% | 99.99% | 99.99% |

| HEK2-7 pNMG-384 |   | 16 T | 12 T | 9 T | 8 T | 7 T | 5 T | 4 T | 3 T | 2 T |
|---|---|---|---|---|---|---|---|---|---|---|
| | A | 0.00% | 0.01% | 0.00% | 0.00% | 0.00% | 0.01% | 0.00% | 0.00% | 0.00% |
| | C | 0.01% | 0.01% | 0.02% | 0.00% | 0.01% | 0.10% | 0.01% | 0.02% | 0.01% |
| | G | 0.00% | 0.00% | 0.00% | 0.00% | 0.00% | 0.01% | 0.00% | 0.00% | 0.00% |
| | T | 99.98% | 99.98% | 99.98% | 99.99% | 99.99% | 99.89% | 99.99% | 99.98% | 99.99% |

FIGURE 119 (Continued)

HEK2-7- 3'-CCTGCAGT₁₆ CAAT₁₂ GAT₉T₈T₇ GT₅T₄T₃T₂ G-5'

| HEK2-7 pNMG-385 | | 16 T | 12 T | 9 T | 8 T | 7 T | 5 T | 4 T | 3 T | 2 T |
|---|---|---|---|---|---|---|---|---|---|---|
| | A | 0.01% | 0.00% | 0.00% | 0.01% | 0.00% | 0.00% | 0.00% | 0.00% | 0.00% |
| | C | 0.01% | 0.01% | 0.01% | 0.02% | 0.00% | 0.09% | 0.02% | 0.01% | 0.01% |
| | G | 0.00% | 0.01% | 0.00% | 0.00% | 0.00% | 0.01% | 0.00% | 0.00% | 0.00% |
| | T | 99.99% | 99.97% | 99.99% | 99.97% | 100.00% | 99.91% | 99.98% | 99.99% | 99.98% |

| HEK2-7 pNMG-386 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.00% | 0.01% | 0.00% | 0.00% | 0.00% |
| | C | 0.01% | 0.01% | 0.02% | 0.01% | 0.01% | 0.14% | 0.01% | 0.01% | 0.00% |
| | G | 0.00% | 0.00% | 0.00% | 0.00% | 0.00% | 0.00% | 0.00% | 0.00% | 0.00% |
| | T | 99.98% | 99.99% | 99.98% | 99.99% | 99.98% | 99.85% | 99.99% | 99.99% | 99.99% |

| HEK2-7 pNMG-387 | | 16 T | 12 T | 9 T | 8 T | 7 T | 5 T | 4 T | 3 T | 2 T |
|---|---|---|---|---|---|---|---|---|---|---|
| | A | 0.01% | 0.00% | 0.00% | 0.00% | 0.01% | 0.00% | 0.01% | 0.00% | 0.00% |
| | C | 0.01% | 0.01% | 0.02% | 0.02% | 0.01% | 0.14% | 0.01% | 0.02% | 0.01% |
| | G | 0.00% | 0.01% | 0.00% | 0.00% | 0.00% | 0.01% | 0.00% | 0.00% | 0.00% |
| | T | 99.98% | 99.98% | 99.98% | 99.98% | 99.98% | 99.85% | 99.98% | 99.97% | 99.99% |

| HEK2-7 pNMG-388 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.00% | 0.00% | 0.00% | 0.00% | 0.00% |
| | C | 0.02% | 0.02% | 0.00% | 0.02% | 0.02% | 0.38% | 0.05% | 0.00% | 0.03% |
| | G | 0.00% | 0.00% | 0.00% | 0.00% | 0.00% | 0.00% | 0.00% | 0.01% | 0.02% |
| | T | 99.98% | 99.97% | 99.99% | 99.98% | 99.98% | 99.62% | 99.95% | 99.99% | 99.95% |

| HEK2-7 pNMG-389 | | 16 T | 12 T | 9 T | 8 T | 7 T | 5 T | 4 T | 3 T | 2 T |
|---|---|---|---|---|---|---|---|---|---|---|
| | A | 0.01% | 0.00% | 0.00% | 0.00% | 0.00% | 0.00% | 0.00% | 0.00% | 0.01% |
| | C | 0.02% | 0.01% | 0.02% | 0.02% | 0.01% | 0.27% | 0.02% | 0.01% | 0.01% |
| | G | 0.00% | 0.01% | 0.00% | 0.00% | 0.01% | 0.00% | 0.00% | 0.00% | 0.00% |
| | T | 99.98% | 99.98% | 99.98% | 99.97% | 99.98% | 99.73% | 99.98% | 99.99% | 99.99% |

FIGURE 120

Hek2-10 site: 3'-CCATCAT$_{17}$T$_{16}$CT$_{14}$AT$_{12}$T$_{11}$CT$_9$T$_8$T$_7$AT$_5$GT$_3$T$_2$C-5'

| HEK2-10 pNMG-370 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.05% | 0.01% | 0.00% | 0.00% | 0.00% | 0.00% | 0.01% | 0.01% | 0.00% | 0.01% |
| | C | 0.01% | 0.01% | 0.02% | 0.19% | 0.22% | 0.19% | 0.57% | 0.94% | 6.27% | 0.53% | 0.26% |
| | G | 0.02% | 0.00% | 0.00% | 0.00% | 0.02% | 0.00% | 0.00% | 0.00% | 0.00% | 0.00% | 0.00% |
| | T | 99.97% | 99.94% | 99.98% | 99.80% | 99.76% | 99.80% | 99.43% | 99.05% | 93.72% | 99.46% | 99.73% |

| HEK2-10 pNMG-371 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.01% | 0.01% | 0.00% | 0.00% | 0.01% | 0.00% | 0.01% | 0.01% | 0.00% | 0.00% |
| | C | 0.01% | 0.01% | 0.01% | 0.09% | 0.69% | 0.73% | 2.06% | 4.06% | 7.68% | 2.52% | 0.53% |
| | G | 0.02% | 0.00% | 0.01% | 0.00% | 0.02% | 0.00% | 0.00% | 0.00% | 0.01% | 0.00% | 0.00% |
| | T | 99.97% | 99.98% | 99.98% | 99.91% | 99.28% | 99.26% | 97.94% | 95.94% | 92.30% | 97.47% | 99.46% |

| HEK2-10 pNMG-382 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.07% | 0.00% | 0.01% | 0.01% | 0.00% | 0.00% | 0.01% | 0.00% | 0.01% | 0.00% |
| | C | 0.01% | 0.01% | 0.01% | 0.23% | 0.18% | 0.03% | 0.33% | 0.23% | 3.62% | 0.29% | 0.31% |
| | G | 0.02% | 0.00% | 0.01% | 0.00% | 0.02% | 0.00% | 0.00% | 0.00% | 0.00% | 0.00% | 0.00% |
| | T | 99.97% | 99.92% | 99.98% | 99.76% | 99.79% | 99.97% | 99.66% | 99.76% | 96.38% | 99.70% | 99.69% |

| HEK2-10 pNMG-383 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.01% | 0.01% | 0.01% | 0.00% | 0.01% | 0.00% | 0.00% | 0.00% | 0.01% | 0.01% |
| | C | 0.01% | 0.01% | 0.01% | 0.05% | 0.75% | 0.08% | 0.15% | 0.20% | 3.71% | 0.19% | 0.12% |
| | G | 0.02% | 0.00% | 0.00% | 0.00% | 0.02% | 0.00% | 0.00% | 0.00% | 0.00% | 0.00% | 0.00% |
| | T | 99.97% | 99.98% | 99.98% | 99.93% | 99.23% | 99.91% | 99.85% | 99.80% | 96.28% | 99.80% | 99.87% |

| HEK2-10 pNMG-384 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.02% | 0.01% | 0.01% | 0.01% | 0.01% | 0.00% | 0.00% | 0.01% | 0.01% | 0.01% |
| | C | 0.01% | 0.01% | 0.01% | 0.11% | 0.83% | 0.04% | 0.13% | 0.11% | 3.14% | 0.12% | 0.14% |
| | G | 0.02% | 0.00% | 0.00% | 0.00% | 0.02% | 0.00% | 0.00% | 0.00% | 0.00% | 0.00% | 0.00% |
| | T | 99.97% | 99.97% | 99.98% | 99.88% | 99.14% | 99.96% | 99.86% | 99.89% | 96.83% | 99.87% | 99.85% |

FIGURE 120 (Continued)

Hek2-10 site: 3'-CCATCAT$_{17}$T$_{16}$CT$_{14}$AT$_{12}$T$_{11}$CT$_9$T$_8$T$_7$AT$_5$GT$_3$T$_2$C-5'

| HEK2-10 pNMG-385 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.02% | 0.00% | 0.00% | 0.00% | 0.01% | 0.00% | 0.00% | 0.01% | 0.01% | 0.00% |
| | C | 0.01% | 0.01% | 0.01% | 0.06% | 0.28% | 0.03% | 0.09% | 0.10% | 1.52% | 0.05% | 0.11% |
| | G | 0.02% | 0.00% | 0.00% | 0.00% | 0.02% | 0.00% | 0.00% | 0.00% | 0.00% | 0.00% | 0.00% |
| | T | 99.97% | 99.97% | 99.99% | 99.94% | 99.69% | 99.97% | 99.91% | 99.90% | 98.47% | 99.94% | 99.88% |

| HEK2-10 pNMG-386 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.07% | 0.01% | 0.00% | 0.01% | 0.01% | 0.01% | 0.00% | 0.01% | 0.01% | 0.01% |
| | C | 0.01% | 0.01% | 0.01% | 0.24% | 0.70% | 0.05% | 0.27% | 0.10% | 2.78% | 0.11% | 0.23% |
| | G | 0.01% | 0.00% | 0.01% | 0.00% | 0.01% | 0.00% | 0.00% | 0.00% | 0.00% | 0.00% | 0.00% |
| | T | 99.97% | 99.92% | 99.98% | 99.76% | 99.28% | 99.96% | 99.72% | 99.90% | 97.21% | 99.88% | 99.76% |

| HEK2-10 pNMG-387 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.01% | 0.05% | 0.00% | 0.01% | 0.00% | 0.00% | 0.00% | 0.00% | 0.01% | 0.01% | 0.00% |
| | C | 0.01% | 0.01% | 0.01% | 0.26% | 0.18% | 0.08% | 0.38% | 0.19% | 3.15% | 0.21% | 0.39% |
| | G | 0.01% | 0.00% | 0.01% | 0.00% | 0.02% | 0.00% | 0.00% | 0.01% | 0.00% | 0.00% | 0.00% |
| | T | 99.97% | 99.95% | 99.98% | 99.74% | 99.80% | 99.92% | 99.60% | 99.80% | 96.83% | 99.78% | 99.61% |

| HEK2-10 pNMG-388 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.03% | 0.00% | 0.00% | 0.00% | 0.00% | 0.00% | 0.00% | 0.01% | 0.01% | 0.01% |
| | C | 0.01% | 0.01% | 0.01% | 0.13% | 0.16% | 0.05% | 0.25% | 0.24% | 4.14% | 0.22% | 0.22% |
| | G | 0.01% | 0.00% | 0.00% | 0.00% | 0.01% | 0.00% | 0.00% | 0.00% | 0.00% | 0.00% | 0.00% |
| | T | 99.97% | 99.96% | 99.99% | 99.87% | 99.83% | 99.96% | 99.75% | 99.75% | 95.85% | 99.77% | 99.77% |

| HEK2-10 pNMG-389 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.02% | 0.01% | 0.00% | 0.00% | 0.01% | 0.00% | 0.00% | 0.00% | 0.00% | 0.01% |
| | C | 0.01% | 0.01% | 0.01% | 0.09% | 0.23% | 0.06% | 0.18% | 0.23% | 3.10% | 0.15% | 0.21% |
| | G | 0.01% | 0.00% | 0.00% | 0.00% | 0.01% | 0.00% | 0.00% | 0.00% | 0.00% | 0.00% | 0.00% |
| | T | 99.97% | 99.97% | 99.99% | 99.91% | 99.76% | 99.93% | 99.82% | 99.77% | 96.89% | 99.84% | 99.78% |

Hek3- 5'-GGCCCA GA CTGA GCA CGTGATGG-3'

FIGURE 122

FANCF- 5'-GGA$_3$A$_4$TCCCTTCTGCA$_{15}$GCA$_{18}$CCTGG-3'

| FANCF pNMG-370 | | 3 A | 4 A | 15 A | 18 A |
|---|---|---|---|---|---|
| | A | 99.93% | 99.40% | 99.98% | 99.98% |
| | C | 0.00% | 0.00% | 0.00% | 0.00% |
| | G | 0.06% | 0.60% | 0.01% | 0.01% |
| | T | 0.01% | 0.00% | 0.00% | 0.00% |

| FANCF pNMG-371 | | 3 A | 4 A | 15 A | 18 A |
|---|---|---|---|---|---|
| | A | 99.67% | 97.88% | 99.98% | 99.98% |
| | C | 0.00% | 0.00% | 0.00% | 0.00% |
| | G | 0.32% | 2.11% | 0.01% | 0.01% |
| | T | 0.01% | 0.00% | 0.00% | 0.01% |

| FANCF pNMG-382 | | 3 A | 4 A | 15 A | 18 A |
|---|---|---|---|---|---|
| | A | 99.93% | 99.69% | 99.99% | 99.98% |
| | C | 0.00% | 0.00% | 0.00% | 0.00% |
| | G | 0.06% | 0.30% | 0.01% | 0.00% |
| | T | 0.00% | 0.01% | 0.00% | 0.01% |

| FANCF pNMG-383 | | 3 A | 4 A | 15 A | 18 A |
|---|---|---|---|---|---|
| | A | 99.94% | 99.76% | 99.98% | 99.98% |
| | C | 0.00% | 0.00% | 0.00% | 0.00% |
| | G | 0.05% | 0.23% | 0.02% | 0.01% |
| | T | 0.00% | 0.00% | 0.00% | 0.01% |

| FANCF pNMG-384 | | 3 A | 4 A | 15 A | 18 A |
|---|---|---|---|---|---|
| | A | 99.92% | 99.83% | 99.98% | 99.98% |
| | C | 0.00% | 0.00% | 0.00% | 0.00% |
| | G | 0.06% | 0.16% | 0.01% | 0.00% |
| | T | 0.01% | 0.01% | 0.00% | 0.01% |

| FANCF pNMG-385 | | 3 A | 4 A | 15 A | 18 A |
|---|---|---|---|---|---|
| | A | 99.94% | 99.82% | 99.99% | 99.98% |
| | C | 0.00% | 0.00% | 0.00% | 0.00% |
| | G | 0.04% | 0.17% | 0.00% | 0.00% |
| | T | 0.02% | 0.01% | 0.00% | 0.01% |

| FANCF pNMG-386 | | 3 A | 4 A | 15 A | 18 A |
|---|---|---|---|---|---|
| | A | 99.94% | 99.82% | 99.98% | 99.98% |
| | C | 0.00% | 0.00% | 0.00% | 0.00% |
| | G | 0.05% | 0.17% | 0.01% | 0.00% |
| | T | 0.01% | 0.01% | 0.00% | 0.01% |

| FANCF pNMG-387 | | 3 A | 4 A | 15 A | 18 A |
|---|---|---|---|---|---|
| | A | 99.94% | 99.74% | 99.98% | 99.98% |
| | C | 0.00% | 0.00% | 0.00% | 0.00% |
| | G | 0.05% | 0.25% | 0.01% | 0.01% |
| | T | 0.01% | 0.00% | 0.00% | 0.00% |

| FANCF pNMG-388 | | 3 A | 4 A | 15 A | 18 A |
|---|---|---|---|---|---|
| | A | 99.94% | 99.69% | 99.98% | 99.98% |
| | C | 0.00% | 0.00% | 0.00% | 0.00% |
| | G | 0.05% | 0.31% | 0.01% | 0.01% |
| | T | 0.01% | 0.00% | 0.00% | 0.01% |

| FANCF pNMG-389 | | 3 A | 4 A | 15 A | 18 A |
|---|---|---|---|---|---|
| | A | 99.92% | 99.85% | 99.99% | 99.98% |
| | C | 0.00% | 0.00% | 0.00% | 0.00% |
| | G | 0.08% | 0.14% | 0.01% | 0.00% |
| | T | 0.00% | 0.00% | 0.00% | 0.01% |

| Site | Protospacer and PAM sequence | pNMG370 | pNMG371 | pNMG382-389 | | | | | | |
|---|---|---|---|---|---|---|---|---|---|---|
| HEK2 | GAACACAAAGCATAGACTGCTGG | 54.0 | 65.4 | 48.4 | 52.9 | 44.6 | 40.3 | 41.0 | 44.8 | 43.6 | 40.6 |
| HEK2-2 | GAATACTAAGCATAGACTCCAGG | 29.1 | 50.1 | 24.5 | 23.8 | 21.8 | 11.3 | 20.5 | 21.6 | 23.6 | 23.4 |
| HEK2-3 | GTAAACAAAGCATAGACTGAGGG | 10.4 | 20.1 | 8.2 | 11.0 | 4.7 | 3.5 | 8.0 | 4.2 | 8.5 | 6.2 |
| HEK2-6 | GAAGACCAAGGATAGACTGCTGG | 4.4 | 7.6 | 4.6 | 5.5 | 2.8 | 1.4 | 2.4 | 2.5 | 3.2 | 2.5 |
| HEK2-7 | GAAAACAAATCATTGACTGCAGG | 0.3 | 0.7 | 0.3 | 0.2 | 0.1 | 0.1 | 0.1 | 0.1 | 0.4 | 0.3 |
| HEK2-10 | GAACATAAAGAATAGAATGATGG | 6.3 | 21.4 | 3.6 | 6.3 | 4.6 | 2.0 | 4.2 | 4.1 | 5.5 | 4.0 |

384 ug/mL spectinomycin (5h):

| position: | 36 | 37 | 47 | 48 | 49 | 51 | 69 | 70 | 72 | 77 | 84 | 106 | 108 | 123 | 134 | 146 | 147 | 154 | 155 | 156 | 157 | 159 | 160 | 161 | 163 |
|---|---|---|---|---|---|---|---|---|---|---|---|---|---|---|---|---|---|---|---|---|---|---|---|---|---|
| wt res: | His | Asn | Arg | Pro | Ile | Arg | Val | Met | Asn | Asp | Leu | Ala | Asp | His | Glu | Ser | Asp | Gln | Glu | Ile | Lys | Ala | Lys | Lys | Gln |
| 1 | | Thr | | | | | | | | | | | | | | | | | | | | | | | |
| 2 | | | | | | | | Leu | | | Phe | Val | Asn | Tyr | | | Tyr | | Val | Phe | Asn | | | | |
| 3 | Leu | | | Thr | Val | | | | | | Phe | Val | Asn | Tyr | | | Tyr | | Val | Phe | Asn | | | | |
| 4 | | | | | | Leu | | | | | Phe | Val | Asn | Tyr | | | Tyr | | Val | Phe | Asn | | | | |
| 5 | | Ser | | | | His | | | | | Phe | Val | Asn | Tyr | | | Tyr | | Val | Phe | | | | | |
| 6 | | | | | | | | | | Gly | Phe | Val | Asn | Tyr | | Cys | Tyr | | Val | Phe | | | | Thr | |
| 7 | Leu | | | | | | | | | | Phe | Val | Asn | Tyr | | | Tyr | | Val | Phe | | | | | |
| 8 | | | | | | | | | | | Phe | Val | Asn | Tyr | | Arg | Tyr | | Val | Phe | | | | Thr | |
| 9 | | | | | | | | | | | Phe | Val | Asn | Tyr | | | Tyr | | Val | Phe | | | | | | evolution #1
evolution #2
evolution #3

FIGURE 126B

384 ug/mL spectinomycin (7h):

| position: | 36 | 37 | 47 | 48 | 49 | 51 | 69 | 70 | 72 | 77 | 84 | 106 | 108 | 123 | 134 | 146 | 147 | 154 | 155 | 156 | 157 | 159 | 160 | 161 | 163 |
|---|---|---|---|---|---|---|---|---|---|---|---|---|---|---|---|---|---|---|---|---|---|---|---|---|---|
| wt res: | His | Asn | Arg | Pro | Ile | Arg | Val | Met | Asn | Asp | Leu | Ala | Asp | His | Glu | Ser | Asp | Gln | Glu | Ile | Lys | Ala | Lys | Lys | Gln |
| 1 | | Ser | | | | Leu | | | | | Phe | Val | Asn | Tyr | | | Tyr | | Val | Phe | | | | | |
| 2 | | | | | | Leu | | | Ser | | Phe | Val | Asn | Tyr | | | Tyr | | Val | Phe | | | | | |
| 3 | | | | | | His | | | | | Phe | Val | Asn | Tyr | | | Tyr | | | Phe | | | Ile | | |
| 4 | | Ser | | | | Leu | | | | | Phe | Val | Asn | Tyr | | | Tyr | | Val | Phe | Asn | | | | |
| 5 | | | | | | His | | | | | Phe | Val | Asn | Tyr | | Cys | Tyr | | Val | Phe | | | | | |
| 6 | | Ser | | | | | | | | Gly | Phe | Val | Asn | Tyr | | | Tyr | | Val | Phe | | | | | |
| 7 | | | | | | | | | | | Phe | Val | Asn | Tyr | | | Tyr | | Val | Phe | | | | | | evolution #1
evolution #2
evolution #3

FIGURE 126C 128 ug/mL chloramphenicol (7h):

| position: | 36 | 37 | 47 | 48 | 49 | 51 | 69 | 70 | 72 | 77 | 84 | 106 | 108 | 123 | 134 | 146 | 147 | 154 | 155 | 156 | 157 | 159 | 160 | 161 | 163 |
|---|---|---|---|---|---|---|---|---|---|---|---|---|---|---|---|---|---|---|---|---|---|---|---|---|---|
| wt res: | His | Asn | Arg | Pro | Ile | Arg | Val | Met | Asn | Asp | Leu | Ala | Asp | His | Glu | Ser | Asp | Gln | Glu | Ile | Lys | Ala | Lys | Lys | Gln |
| 1 | | | | | | | | | | | Phe | Val | Asn | Tyr | | Arg | Tyr | | Val | Phe | | | | | |
| 2 | | | | | Leu | | | | | | Phe | Val | Asn | Tyr | | | Tyr | | Val | Phe | | | | | |
| 3 | | Thr | | Thr | Val | | | Leu | | | Phe | Val | Asn | Tyr | | Arg | Tyr | | Val | Phe | | | | | |
| 4 | | | | Thr | Val | | | Leu | | | Phe | Val | Asn | Tyr | | Cys | Tyr | | Val | Phe | | | | | |
| 5 | | | | | | | | | | | Phe | Val | Asn | Tyr | | | Tyr | | Val | Phe | | | | Thr | |
| 2 | | | | | Leu | | | | | | Phe | Val | Asn | Tyr | | Arg | Tyr | | Val | Phe | | | | | |
| 3 | | | | | | | | | | Gly | Phe | Val | Asn | Tyr | | | Tyr | His | Val | Phe | | | | | | evolution #1
evolution #2
evolution #3

FIGURE 126D 128 ug/mL chloramphenicol + 128 ug/mL spectinomycin (overnight):

| position: | 36 | 37 | 47 | 48 | 49 | 51 | 69 | 70 | 72 | 77 | 84 | 106 | 108 | 123 | 134 | 146 | 147 | 154 | 155 | 156 | 157 | 159 | 160 | 161 | 163 |
|---|---|---|---|---|---|---|---|---|---|---|---|---|---|---|---|---|---|---|---|---|---|---|---|---|---|
| wt res: | His | Asn | Arg | Pro | Ile | Arg | Val | Met | Asn | Asp | Leu | Ala | Asp | His | Glu | Ser | Asp | Gln | Glu | Ile | Lys | Ala | Lys | Lys | Gln |
| 1 | | | | | | | | Thr | | | Phe | Val | Asn | Tyr | | | Asp | | Glu | Phe | | | | | |
| 2 | | | | | | | | | | | Phe | Val | Asn | Tyr | | | | | Glu | Phe | | | | | | evolution #1
evolution #2
evolution #3

FIGURE 126E 128 ug/mL chloramphenicol + 256 ug/mL spectinomycin (overnight):

| position: | 36 | 37 | 47 | 48 | 49 | 51 | 69 | 70 | 72 | 77 | 84 | 106 | 108 | 123 | 134 | 146 | 147 | 154 | 155 | 156 | 157 | 159 | 160 | 161 | 163 |
|---|---|---|---|---|---|---|---|---|---|---|---|---|---|---|---|---|---|---|---|---|---|---|---|---|---|
| wt res: | His | Asn | Arg | Pro | Ile | Arg | Val | Met | Asn | Asp | Leu | Ala | Asp | His | Glu | Ser | Asp | Gln | Glu | Ile | Lys | Ala | Lys | Lys | Gln |
| 1 | | | | | | | | | | | Phe | Val | Asn | Tyr | | | | | | Phe | | | | Thr | |
| 2 | | Ser | | | | | | | Ser | | Phe | Val | Asn | Tyr | | | | | | Phe | | | | | |
| 3 | | | | | | | | | | | Phe | Val | Asn | Tyr | | | | | | Phe | | | | | |
| 4 | | | | | | | | | | | Phe | Val | Asn | Tyr | Gly | | Cys | | | Phe | | | | | | evolution #1
evolution #2
evolution #3

FIGURE 127

| position: | 36 | 37 | 47 | 48 | 49 | 51 | 61 | 69 | 70 | 72 | 76 | 77 | 78 | 84 | 91 | 96 | 104 | 106 | 108 | 123 | 125 | 134 | 146 | 147 | 154 | 155 | 156 | 157 | 159 | 160 | 161 | 162 | 163 |
|---|---|---|---|---|---|---|---|---|---|---|---|---|---|---|---|---|---|---|---|---|---|---|---|---|---|---|---|---|---|---|---|---|---|
| wt res: | His | Asn | Arg | Pro | Ile | Arg | Met | Val | Met | Asn | Ile | Asp | Ala | Leu | Ala | Ser | Phe | Ala | Asp | His | Gly | Glu | Ser | Asp | Gln | Glu | Ile | Lys | Ala | Lys | Lys | Ala | Gln |
| 1 | | | | | | | | | | | Thr | | | Phe | | | | Val | Asn | Tyr | | | | | | | Phe | | | | | | |
| 2 | | | | | | | | | | | | His | Thr | Phe | | | | Val | Asn | Tyr | | | | | | | Phe | | | | | | |
| 3 | | | | | | | | | | Asp | | | | Phe | | | | Val | Asn | Tyr | Ala | | | | | | Phe | | | | | | |
| 4 | | | | Ser | | | | | | | | | | Phe | | Cys | | Val | Asn | Tyr | | | | | | | Phe | | | | | Val | |
| 5 | | | | Leu | | | | | | | | | | Phe | Thr | | | Val | Asn | Tyr | | | | | | | Phe | | | | | | |
| 6 | | | | | | | | | | | | | | Phe | | | Ile | Val | Asn | Tyr | | | | | | | Phe | | | | | | |
| 7 | | | | | | | | | | | | | | Phe | | | | Val | Asn | Tyr | | Val | | | | | Phe | | | | | | | evolution #1
evolution #2
evolution #3

FIGURE 129

Hek-2 site: 5'-GA$_2$A$_3$CA$_5$CA$_7$A$_8$A$_9$GCA$_{12}$TA$_{14}$GA$_{16}$CTGCGGG-3'

| HEK2 pNMG-339 | | 2 A | 3 A | 5 A | 7 A | 8 A | 9 A | 12 A | 14 A | 16 A |
|---|---|---|---|---|---|---|---|---|---|---|
| | A | 99.8% | 95.9% | 44.1% | 98.4% | 98.5% | 99.3% | 99.9% | 100.0% | 100.0% |
| | C | 0.0% | 0.0% | 0.0% | 0.0% | 0.0% | 0.0% | 0.0% | 0.0% | 0.0% |
| | G | 0.2% | 4.1% | 55.9% | 1.6% | 1.5% | 0.7% | 0.0% | 0.0% | 0.0% |
| | T | 0.0% | 0.0% | 0.0% | 0.0% | 0.0% | 0.0% | 0.0% | 0.0% | 0.0% |

| HEK2 pNMG-340 | | 2 A | 3 A | 5 A | 7 A | 8 A | 9 A | 12 A | 14 A | 16 A |
|---|---|---|---|---|---|---|---|---|---|---|
| | A | 99.89% | 97.88% | 34.81% | 99.43% | 98.98% | 99.54% | 99.98% | 99.99% | 99.99% |
| | C | 0.00% | 0.00% | 0.00% | 0.00% | 0.00% | 0.00% | 0.00% | 0.00% | 0.00% |
| | G | 0.10% | 2.12% | 65.18% | 0.56% | 1.02% | 0.45% | 0.01% | 0.01% | 0.01% |
| | T | 0.00% | 0.00% | 0.01% | 0.00% | 0.01% | 0.00% | 0.00% | 0.00% | 0.00% |

| HEK2 pNMG-341 | | 2 A | 3 A | 5 A | 7 A | 8 A | 9 A | 12 A | 14 A | 16 A |
|---|---|---|---|---|---|---|---|---|---|---|
| | A | 99.80% | 94.79% | 29.76% | 98.16% | 98.08% | 99.02% | 99.92% | 99.98% | 99.99% |
| | C | 0.00% | 0.01% | 0.00% | 0.00% | 0.00% | 0.00% | 0.00% | 0.00% | 0.00% |
| | G | 0.19% | 5.19% | 70.23% | 1.84% | 1.91% | 0.98% | 0.07% | 0.02% | 0.01% |
| | T | 0.00% | 0.01% | 0.01% | 0.00% | 0.00% | 0.00% | 0.00% | 0.01% | 0.00% |

| HEK2 pNMG-346 | | 2 A | 3 A | 5 A | 7 A | 8 A | 9 A | 12 A | 14 A | 16 A |
|---|---|---|---|---|---|---|---|---|---|---|
| | A | 99.97% | 99.89% | 93.08% | 99.94% | 99.98% | 99.89% | 99.99% | 99.98% | 99.99% |
| | C | 0.00% | 0.01% | 0.00% | 0.00% | 0.00% | 0.00% | 0.00% | 0.00% | 0.00% |
| | G | 0.02% | 0.10% | 6.91% | 0.04% | 0.01% | 0.10% | 0.01% | 0.01% | 0.01% |
| | T | 0.00% | 0.00% | 0.01% | 0.02% | 0.01% | 0.00% | 0.01% | 0.00% | 0.00% |

| HEK2 pNMG-347 | | 2 A | 3 A | 5 A | 7 A | 8 A | 9 A | 12 A | 14 A | 16 A |
|---|---|---|---|---|---|---|---|---|---|---|
| | A | 99.97% | 99.68% | 87.50% | 99.88% | 99.86% | 99.74% | 99.99% | 99.99% | 99.99% |
| | C | 0.00% | 0.01% | 0.00% | 0.00% | 0.00% | 0.00% | 0.00% | 0.00% | 0.00% |
| | G | 0.03% | 0.31% | 12.49% | 0.11% | 0.13% | 0.26% | 0.01% | 0.01% | 0.01% |
| | T | 0.01% | 0.00% | 0.01% | 0.00% | 0.00% | 0.00% | 0.01% | 0.00% | 0.00% |

| HEK2 pNMG-348 | | 2 A | 3 A | 5 A | 7 A | 8 A | 9 A | 12 A | 14 A | 16 A |
|---|---|---|---|---|---|---|---|---|---|---|
| | A | 99.98% | 99.72% | 84.58% | 99.93% | 99.93% | 99.90% | 99.92% | 99.96% | 99.99% |
| | C | 0.00% | 0.00% | 0.00% | 0.00% | 0.00% | 0.00% | 0.00% | 0.00% | 0.00% |
| | G | 0.01% | 0.27% | 15.41% | 0.06% | 0.06% | 0.10% | 0.07% | 0.02% | 0.01% |
| | T | 0.00% | 0.01% | 0.01% | 0.00% | 0.00% | 0.00% | 0.01% | 0.01% | 0.00% |

| HEK2 pNMG-349 | | 2 A | 3 A | 5 A | 7 A | 8 A | 9 A | 12 A | 14 A | 16 A |
|---|---|---|---|---|---|---|---|---|---|---|
| | A | 99.98% | 99.71% | 85.59% | 99.94% | 99.84% | 99.92% | 99.97% | 99.97% | 99.99% |
| | C | 0.00% | 0.00% | 0.00% | 0.00% | 0.00% | 0.00% | 0.00% | 0.00% | 0.00% |
| | G | 0.02% | 0.28% | 14.40% | 0.05% | 0.15% | 0.07% | 0.02% | 0.02% | 0.01% |
| | T | 0.00% | 0.00% | 0.01% | 0.00% | 0.01% | 0.00% | 0.01% | 0.01% | 0.00% |

FIGURE 130

Hek 2-1 site: 5'-GA$_2$A$_3$A$_4$A$_5$A$_6$A$_7$A$_8$A$_9$GCA$_{12}$GA$_{14}$GACTGCTGG-3'

| HEK2-1 pNMG-339 | | 2 A | 3 A | 4 A | 5 A | 6 A | 7 A | 8 A | 9 A | 12 A | 14 A |
|---|---|---|---|---|---|---|---|---|---|---|---|
| | A | 99.99% | 99.99% | 99.97% | 99.90% | 99.97% | 99.98% | 99.98% | 99.97% | 99.97% | 99.99% |
| | C | 0.00% | 0.00% | 0.00% | 0.00% | 0.00% | 0.00% | 0.00% | 0.00% | 0.00% | 0.00% |
| | G | 0.01% | 0.01% | 0.03% | 0.10% | 0.03% | 0.01% | 0.01% | 0.02% | 0.02% | 0.01% |
| | T | 0.00% | 0.00% | 0.00% | 0.00% | 0.00% | 0.00% | 0.01% | 0.00% | 0.01% | 0.01% |

| HEK2-1 pNMG-340 | | 2 A | 3 A | 4 A | 5 A | 6 A | 7 A | 8 A | 9 A | 12 A | 14 A |
|---|---|---|---|---|---|---|---|---|---|---|---|
| | A | 99.98% | 99.99% | 99.98% | 99.88% | 99.98% | 99.99% | 99.99% | 99.97% | 99.98% | 99.99% |
| | C | 0.00% | 0.00% | 0.00% | 0.00% | 0.00% | 0.00% | 0.00% | 0.00% | 0.00% | 0.00% |
| | G | 0.01% | 0.01% | 0.01% | 0.11% | 0.02% | 0.01% | 0.01% | 0.03% | 0.01% | 0.01% |
| | T | 0.00% | 0.00% | 0.00% | 0.00% | 0.00% | 0.00% | 0.01% | 0.00% | 0.01% | 0.01% |

| HEK2-1 pNMG-341 | | 2 A | 3 A | 4 A | 5 A | 6 A | 7 A | 8 A | 9 A | 12 A | 14 A |
|---|---|---|---|---|---|---|---|---|---|---|---|
| | A | 99.98% | 99.99% | 99.94% | 99.80% | 99.93% | 99.98% | 99.98% | 99.98% | 99.98% | 99.99% |
| | C | 0.00% | 0.00% | 0.00% | 0.00% | 0.00% | 0.00% | 0.00% | 0.00% | 0.00% | 0.00% |
| | G | 0.01% | 0.01% | 0.05% | 0.20% | 0.07% | 0.01% | 0.01% | 0.02% | 0.01% | 0.01% |
| | T | 0.01% | 0.00% | 0.00% | 0.00% | 0.00% | 0.00% | 0.00% | 0.00% | 0.01% | 0.01% |

| HEK2-1 pNMG-346 | | 2 A | 3 A | 4 A | 5 A | 6 A | 7 A | 8 A | 9 A | 12 A | 14 A |
|---|---|---|---|---|---|---|---|---|---|---|---|
| | A | 99.99% | 99.99% | 99.99% | 99.99% | 99.99% | 99.99% | 99.98% | 99.97% | 99.98% | 99.99% |
| | C | 0.00% | 0.00% | 0.00% | 0.00% | 0.00% | 0.00% | 0.00% | 0.00% | 0.00% | 0.00% |
| | G | 0.01% | 0.01% | 0.00% | 0.01% | 0.01% | 0.01% | 0.01% | 0.02% | 0.01% | 0.01% |
| | T | 0.00% | 0.00% | 0.00% | 0.00% | 0.00% | 0.00% | 0.01% | 0.00% | 0.01% | 0.01% |

| HEK2-1 pNMG-347 | | 2 A | 3 A | 4 A | 5 A | 6 A | 7 A | 8 A | 9 A | 12 A | 14 A |
|---|---|---|---|---|---|---|---|---|---|---|---|
| | A | 99.99% | 99.99% | 99.99% | 99.98% | 99.99% | 99.99% | 99.99% | 99.98% | 99.97% | 99.99% |
| | C | 0.00% | 0.00% | 0.00% | 0.00% | 0.00% | 0.00% | 0.00% | 0.00% | 0.00% | 0.00% |
| | G | 0.01% | 0.00% | 0.01% | 0.02% | 0.01% | 0.00% | 0.01% | 0.02% | 0.02% | 0.01% |
| | T | 0.00% | 0.00% | 0.00% | 0.00% | 0.00% | 0.00% | 0.00% | 0.00% | 0.01% | 0.01% |

| HEK2-1 pNMG-348 | | 2 A | 3 A | 4 A | 5 A | 6 A | 7 A | 8 A | 9 A | 12 A | 14 A |
|---|---|---|---|---|---|---|---|---|---|---|---|
| | A | 99.99% | 99.99% | 99.99% | 99.99% | 99.99% | 99.99% | 99.99% | 99.98% | 99.98% | 99.99% |
| | C | 0.00% | 0.00% | 0.00% | 0.00% | 0.00% | 0.00% | 0.00% | 0.00% | 0.00% | 0.00% |
| | G | 0.00% | 0.01% | 0.01% | 0.01% | 0.00% | 0.01% | 0.01% | 0.02% | 0.01% | 0.01% |
| | T | 0.00% | 0.00% | 0.00% | 0.00% | 0.00% | 0.00% | 0.00% | 0.00% | 0.01% | 0.01% |

| HEK2-1 pNMG-349 | | 2 A | 3 A | 4 A | 5 A | 6 A | 7 A | 8 A | 9 A | 12 A | 14 A |
|---|---|---|---|---|---|---|---|---|---|---|---|
| | A | 99.99% | 99.99% | 100.00% | 99.99% | 99.99% | 99.99% | 99.99% | 99.98% | 99.97% | 99.99% |
| | C | 0.00% | 0.00% | 0.00% | 0.00% | 0.00% | 0.00% | 0.00% | 0.00% | 0.00% | 0.00% |
| | G | 0.00% | 0.01% | 0.00% | 0.01% | 0.01% | 0.01% | 0.01% | 0.02% | 0.02% | 0.01% |
| | T | 0.00% | 0.00% | 0.00% | 0.00% | 0.00% | 0.00% | 0.00% | 0.00% | 0.01% | 0.01% |

FIGURE 131

Hek 2-2 site: 5'-GA$_2$A$_3$TA$_5$CTA$_8$A$_9$GCA$_{12}$TA$_{14}$GA$_{16}$CTCCAGG-3'

| HEK2-2 pNMG-339 | | 2<br>A | 3<br>A | 5<br>A | 8<br>A | 9<br>A | 12<br>A | 14<br>A | 16<br>A |
|---|---|---|---|---|---|---|---|---|---|
| | A | 99.63% | 99.44% | 98.65% | 99.54% | 99.65% | 99.97% | 99.97% | 99.97% |
| | C | 0.00% | 0.00% | 0.00% | 0.00% | 0.00% | 0.00% | 0.00% | 0.00% |
| | G | 0.36% | 0.55% | 1.44% | 0.45% | 0.35% | 0.01% | 0.01% | 0.01% |
| | T | 0.01% | 0.00% | 0.01% | 0.01% | 0.00% | 0.01% | 0.01% | 0.01% |

| HEK2-2 pNMG-340 | | 2<br>A | 3<br>A | 5<br>A | 8<br>A | 9<br>A | 12<br>A | 14<br>A | 16<br>A |
|---|---|---|---|---|---|---|---|---|---|
| | A | 99.84% | 99.83% | 96.66% | 99.59% | 99.91% | 99.98% | 99.97% | 99.97% |
| | C | 0.00% | 0.00% | 0.00% | 0.00% | 0.00% | 0.00% | 0.00% | 0.00% |
| | G | 0.15% | 0.16% | 3.32% | 0.40% | 0.09% | 0.01% | 0.01% | 0.01% |
| | T | 0.00% | 0.01% | 0.02% | 0.00% | 0.00% | 0.01% | 0.01% | 0.01% |

| HEK2-2 pNMG-341 | | 2<br>A | 3<br>A | 5<br>A | 8<br>A | 9<br>A | 12<br>A | 14<br>A | 16<br>A |
|---|---|---|---|---|---|---|---|---|---|
| | A | 99.56% | 99.29% | 92.66% | 99.35% | 99.60% | 99.95% | 99.97% | 99.97% |
| | C | 0.00% | 0.00% | 0.00% | 0.00% | 0.00% | 0.00% | 0.00% | 0.00% |
| | G | 0.42% | 0.70% | 7.33% | 0.64% | 0.40% | 0.03% | 0.01% | 0.01% |
| | T | 0.01% | 0.00% | 0.01% | 0.01% | 0.00% | 0.02% | 0.01% | 0.01% |

| HEK2-2 pNMG-346 | | 2<br>A | 3<br>A | 5<br>A | 8<br>A | 9<br>A | 12<br>A | 14<br>A | 16<br>A |
|---|---|---|---|---|---|---|---|---|---|
| | A | 99.99% | 99.98% | 90.58% | 99.94% | 99.98% | 99.98% | 99.97% | 99.97% |
| | C | 0.00% | 0.00% | 0.00% | 0.00% | 0.00% | 0.00% | 0.00% | 0.00% |
| | G | 0.00% | 0.02% | 9.40% | 0.05% | 0.02% | 0.01% | 0.01% | 0.01% |
| | T | 0.01% | 0.00% | 0.02% | 0.01% | 0.01% | 0.01% | 0.01% | 0.01% |

| HEK2-2 pNMG-347 | | 2<br>A | 3<br>A | 5<br>A | 8<br>A | 9<br>A | 12<br>A | 14<br>A | 16<br>A |
|---|---|---|---|---|---|---|---|---|---|
| | A | 99.99% | 99.96% | 84.82% | 99.93% | 99.97% | 99.97% | 99.97% | 99.97% |
| | C | 0.00% | 0.00% | 0.00% | 0.00% | 0.00% | 0.00% | 0.00% | 0.00% |
| | G | 0.01% | 0.03% | 15.16% | 0.06% | 0.03% | 0.01% | 0.01% | 0.01% |
| | T | 0.01% | 0.00% | 0.01% | 0.00% | 0.00% | 0.02% | 0.01% | 0.01% |

| HEK2-2 pNMG-348 | | 2<br>A | 3<br>A | 5<br>A | 8<br>A | 9<br>A | 12<br>A | 14<br>A | 16<br>A |
|---|---|---|---|---|---|---|---|---|---|
| | A | 99.98% | 99.93% | 85.35% | 99.91% | 99.98% | 99.97% | 99.97% | 99.97% |
| | C | 0.00% | 0.00% | 0.00% | 0.00% | 0.00% | 0.00% | 0.00% | 0.00% |
| | G | 0.01% | 0.07% | 14.61% | 0.08% | 0.02% | 0.01% | 0.01% | 0.01% |
| | T | 0.01% | 0.00% | 0.02% | 0.01% | 0.00% | 0.02% | 0.01% | 0.01% |

| HEK2-2 pNMG-349 | | 2<br>A | 3<br>A | 5<br>A | 8<br>A | 9<br>A | 12<br>A | 14<br>A | 16<br>A |
|---|---|---|---|---|---|---|---|---|---|
| | A | 99.98% | 99.95% | 86.93% | 99.92% | 99.99% | 99.97% | 99.97% | 99.97% |
| | C | 0.00% | 0.00% | 0.00% | 0.00% | 0.00% | 0.00% | 0.00% | 0.00% |
| | G | 0.01% | 0.05% | 13.06% | 0.07% | 0.01% | 0.01% | 0.01% | 0.01% |
| | T | 0.01% | 0.01% | 0.01% | 0.01% | 0.00% | 0.02% | 0.01% | 0.01% |

FIGURE 132

Hek 2-3 site: 5'-GTA$_3$A$_4$A$_5$CA$_7$A$_8$A$_9$GCA$_{12}$TA$_{14}$GA$_{16}$CTGAGGG-3'

| HEK2-3 pNMG-339 | | 3 A | 4 A | 5 A | 7 A | 8 A | 9 A | 12 A | 14 A | 16 A |
|---|---|---|---|---|---|---|---|---|---|---|
| | A | 99.98% | 99.98% | 99.43% | 99.98% | 99.97% | 99.98% | 99.97% | 99.97% | 99.97% |
| | C | 0.00% | 0.00% | 0.00% | 0.00% | 0.00% | 0.00% | 0.00% | 0.00% | 0.00% |
| | G | 0.01% | 0.02% | 0.56% | 0.01% | 0.01% | 0.01% | 0.01% | 0.01% | 0.01% |
| | T | 0.01% | 0.00% | 0.01% | 0.00% | 0.01% | 0.01% | 0.01% | 0.01% | 0.01% |

| HEK2-3 pNMG-340 | | 3 A | 4 A | 5 A | 7 A | 8 A | 9 A | 12 A | 14 A | 16 A |
|---|---|---|---|---|---|---|---|---|---|---|
| | A | 99.97% | 99.96% | 99.02% | 99.96% | 99.97% | 99.76% | 99.96% | 99.97% | 99.97% |
| | C | 0.00% | 0.00% | 0.00% | 0.00% | 0.00% | 0.19% | 0.00% | 0.00% | 0.00% |
| | G | 0.03% | 0.03% | 0.97% | 0.03% | 0.03% | 0.05% | 0.02% | 0.01% | 0.01% |
| | T | 0.01% | 0.01% | 0.01% | 0.01% | 0.00% | 0.00% | 0.02% | 0.01% | 0.01% |

| HEK2-3 pNMG-341 | | 3 A | 4 A | 5 A | 7 A | 8 A | 9 A | 12 A | 14 A | 16 A |
|---|---|---|---|---|---|---|---|---|---|---|
| | A | 99.97% | 99.95% | 98.58% | 99.97% | 99.97% | 99.79% | 99.96% | 99.97% | 99.97% |
| | C | 0.00% | 0.00% | 0.00% | 0.00% | 0.00% | 0.19% | 0.00% | 0.00% | 0.00% |
| | G | 0.02% | 0.05% | 1.42% | 0.01% | 0.02% | 0.02% | 0.02% | 0.01% | 0.01% |
| | T | 0.01% | 0.01% | 0.01% | 0.01% | 0.01% | 0.00% | 0.02% | 0.01% | 0.01% |

FIGURE 133

Hek 2-4 site: 5'-GGA$_3$CA$_5$CA$_7$A$_8$A$_9$GCTTA$_{14}$GA$_{16}$CTCCAGG-3'

| HEK2-4 pNMG-339 | | 3 A | 5 A | 7 A | 8 A | 9 A | 14 A | 16 A |
|---|---|---|---|---|---|---|---|---|
| | A | 95.12% | 75.77% | 99.50% | 99.35% | 99.67% | 99.98% | 99.98% |
| | C | 0.00% | 0.01% | 0.00% | 0.00% | 0.00% | 0.00% | 0.00% |
| | G | 4.87% | 24.21% | 0.49% | 0.64% | 0.32% | 0.01% | 0.01% |
| | T | 0.01% | 0.01% | 0.01% | 0.01% | 0.00% | 0.00% | 0.00% |

| HEK2-4 pNMG-340 | | 3 A | 5 A | 7 A | 8 A | 9 A | 14 A | 16 A |
|---|---|---|---|---|---|---|---|---|
| | A | 97.41% | 76.11% | 99.76% | 99.67% | 99.82% | 99.98% | 99.98% |
| | C | 0.00% | 0.00% | 0.00% | 0.00% | 0.00% | 0.00% | 0.00% |
| | G | 2.58% | 23.88% | 0.23% | 0.32% | 0.17% | 0.02% | 0.01% |
| | T | 0.01% | 0.01% | 0.01% | 0.00% | 0.00% | 0.00% | 0.00% |

| HEK2-4 pNMG-341 | | 3 A | 5 A | 7 A | 8 A | 9 A | 14 A | 16 A |
|---|---|---|---|---|---|---|---|---|
| | A | 93.73% | 84.81% | 99.34% | 99.22% | 99.69% | 99.98% | 99.98% |
| | C | 0.00% | 0.02% | 0.00% | 0.00% | 0.00% | 0.00% | 0.00% |
| | G | 6.26% | 15.17% | 0.65% | 0.78% | 0.30% | 0.02% | 0.01% |
| | T | 0.01% | 0.01% | 0.01% | 0.00% | 0.00% | 0.00% | 0.00% |

FIGURE 134

Hek2-6 similar: 5'-GA$_2$A$_3$GA$_5$CCA$_8$A$_9$GGATAGACTGCTGG-3'

| HEK2-6 pNMG-339 | | 2 A | 3 A | 5 A | 8 A | 9 A | 12 A | 14 A |
|---|---|---|---|---|---|---|---|---|
| | A | 99.94% | 99.86% | 95.56% | 99.74% | 99.90% | 99.97% | 99.98% |
| | C | 0.00% | 0.01% | 0.00% | 0.00% | 0.00% | 0.00% | 0.00% |
| | G | 0.04% | 0.12% | 4.43% | 0.24% | 0.08% | 0.01% | 0.01% |
| | T | 0.01% | 0.01% | 0.01% | 0.02% | 0.01% | 0.02% | 0.00% |

| HEK2-6 pNMG-340 | | 2 A | 3 A | 5 A | 8 A | 9 A | 12 A | 14 A |
|---|---|---|---|---|---|---|---|---|
| | A | 99.97% | 99.97% | 95.74% | 99.81% | 99.90% | 99.98% | 99.98% |
| | C | 0.00% | 0.00% | 0.00% | 0.01% | 0.00% | 0.00% | 0.00% |
| | G | 0.02% | 0.02% | 4.25% | 0.17% | 0.09% | 0.01% | 0.01% |
| | T | 0.01% | 0.00% | 0.02% | 0.01% | 0.01% | 0.01% | 0.00% |

| HEK2-6 pNMG-341 | | 2 A | 3 A | 5 A | 8 A | 9 A | 12 A | 14 A |
|---|---|---|---|---|---|---|---|---|
| | A | 99.94% | 99.86% | 95.56% | 99.74% | 99.90% | 99.97% | 99.98% |
| | C | 0.00% | 0.01% | 0.00% | 0.00% | 0.00% | 0.00% | 0.00% |
| | G | 0.04% | 0.12% | 4.43% | 0.24% | 0.08% | 0.01% | 0.01% |
| | T | 0.01% | 0.01% | 0.01% | 0.02% | 0.01% | 0.02% | 0.00% |

| HEK2-6 pNMG-346 | | 2 A | 3 A | 5 A | 8 A | 9 A | 12 A | 14 A |
|---|---|---|---|---|---|---|---|---|
| | A | 99.98% | 99.99% | 99.76% | 99.97% | 99.98% | 99.98% | 99.98% |
| | C | 0.00% | 0.00% | 0.00% | 0.00% | 0.00% | 0.00% | 0.00% |
| | G | 0.01% | 0.00% | 0.23% | 0.02% | 0.01% | 0.00% | 0.01% |
| | T | 0.01% | 0.01% | 0.01% | 0.01% | 0.01% | 0.01% | 0.00% |

| HEK2-6 pNMG-347 | | 2 A | 3 A | 5 A | 8 A | 9 A | 12 A | 14 A |
|---|---|---|---|---|---|---|---|---|
| | A | 99.95% | 99.97% | 99.62% | 99.97% | 99.95% | 99.97% | 99.98% |
| | C | 0.00% | 0.00% | 0.00% | 0.00% | 0.00% | 0.00% | 0.00% |
| | G | 0.03% | 0.01% | 0.35% | 0.02% | 0.03% | 0.01% | 0.01% |
| | T | 0.02% | 0.01% | 0.02% | 0.00% | 0.02% | 0.02% | 0.00% |

| HEK2-6 pNMG-348 | | 2 A | 3 A | 5 A | 8 A | 9 A | 12 A | 14 A |
|---|---|---|---|---|---|---|---|---|
| | A | 99.97% | 99.96% | 99.66% | 99.97% | 99.97% | 99.98% | 99.98% |
| | C | 0.00% | 0.00% | 0.00% | 0.00% | 0.00% | 0.00% | 0.00% |
| | G | 0.02% | 0.02% | 0.30% | 0.01% | 0.01% | 0.00% | 0.01% |
| | T | 0.01% | 0.01% | 0.02% | 0.01% | 0.02% | 0.02% | 0.01% |

| HEK2-6 pNMG-349 | | 2 A | 3 A | 5 A | 8 A | 9 A | 12 A | 14 A |
|---|---|---|---|---|---|---|---|---|
| | A | 99.97% | 99.97% | 99.74% | 99.97% | 99.97% | 99.97% | 99.98% |
| | C | 0.00% | 0.00% | 0.00% | 0.01% | 0.00% | 0.00% | 0.00% |
| | G | 0.02% | 0.01% | 0.25% | 0.01% | 0.02% | 0.01% | 0.01% |
| | T | 0.01% | 0.01% | 0.01% | 0.01% | 0.00% | 0.01% | 0.00% |

FIGURE 135

Hek2-9 site: 5'-GA$_2$A$_3$A$_4$A$_5$CA$_7$A$_8$A$_9$A$_{10}$CA$_{12}$TA$_{14}$GAGTGCTGG-3'

| HEK2-9 pNMG-339 | | 2<br>A | 3<br>A | 4<br>A | 5<br>A | 7<br>A | 8<br>A | 9<br>A | 10<br>A | 12<br>A | 14<br>A |
|---|---|---|---|---|---|---|---|---|---|---|---|
| | A | 99.95% | 99.90% | 99.69% | 96.43% | 99.74% | 99.76% | 99.54% | 98.67% | 99.97% | 99.97% |
| | C | 0.00% | 0.00% | 0.03% | 0.00% | 0.01% | 0.00% | 0.00% | 0.00% | 0.00% | 0.01% |
| | G | 0.04% | 0.10% | 0.28% | 3.56% | 0.24% | 0.24% | 0.46% | 1.32% | 0.01% | 0.02% |
| | T | 0.00% | 0.00% | 0.00% | 0.00% | 0.01% | 0.00% | 0.00% | 0.01% | 0.01% | 0.01% |

| HEK2-9 pNMG-340 | | 2<br>A | 3<br>A | 4<br>A | 5<br>A | 7<br>A | 8<br>A | 9<br>A | 10<br>A | 12<br>A | 14<br>A |
|---|---|---|---|---|---|---|---|---|---|---|---|
| | A | 99.96% | 99.97% | 99.80% | 96.25% | 99.94% | 99.92% | 99.76% | 99.33% | 99.98% | 99.97% |
| | C | 0.00% | 0.00% | 0.03% | 0.01% | 0.00% | 0.00% | 0.00% | 0.01% | 0.00% | 0.01% |
| | G | 0.03% | 0.03% | 0.17% | 3.73% | 0.05% | 0.07% | 0.24% | 0.66% | 0.01% | 0.02% |
| | T | 0.01% | 0.00% | 0.00% | 0.00% | 0.00% | 0.00% | 0.00% | 0.00% | 0.01% | 0.01% |

| HEK2-9 pNMG-341 | | 2<br>A | 3<br>A | 4<br>A | 5<br>A | 7<br>A | 8<br>A | 9<br>A | 10<br>A | 12<br>A | 14<br>A |
|---|---|---|---|---|---|---|---|---|---|---|---|
| | A | 99.90% | 99.83% | 99.47% | 94.63% | 99.62% | 99.65% | 99.33% | 98.64% | 99.92% | 99.97% |
| | C | 0.00% | 0.00% | 0.02% | 0.01% | 0.00% | 0.00% | 0.00% | 0.00% | 0.00% | 0.01% |
| | G | 0.10% | 0.17% | 0.51% | 5.36% | 0.37% | 0.35% | 0.66% | 1.35% | 0.06% | 0.02% |
| | T | 0.01% | 0.00% | 0.00% | 0.00% | 0.00% | 0.00% | 0.00% | 0.01% | 0.02% | 0.01% |

| HEK2-9 pNMG-346 | | 2<br>A | 3<br>A | 4<br>A | 5<br>A | 7<br>A | 8<br>A | 9<br>A | 10<br>A | 12<br>A | 14<br>A |
|---|---|---|---|---|---|---|---|---|---|---|---|
| | A | 99.98% | 99.98% | 99.96% | 99.90% | 99.99% | 99.98% | 99.99% | 99.95% | 99.98% | 99.98% |
| | C | 0.00% | 0.00% | 0.03% | 0.01% | 0.00% | 0.00% | 0.00% | 0.00% | 0.00% | 0.00% |
| | G | 0.01% | 0.01% | 0.01% | 0.08% | 0.01% | 0.02% | 0.01% | 0.04% | 0.01% | 0.01% |
| | T | 0.01% | 0.01% | 0.00% | 0.00% | 0.00% | 0.00% | 0.00% | 0.01% | 0.01% | 0.01% |

| HEK2-9 pNMG-347 | | 2<br>A | 3<br>A | 4<br>A | 5<br>A | 7<br>A | 8<br>A | 9<br>A | 10<br>A | 12<br>A | 14<br>A |
|---|---|---|---|---|---|---|---|---|---|---|---|
| | A | 100.00% | 99.98% | 99.94% | 99.76% | 99.98% | 99.97% | 99.97% | 99.93% | 99.98% | 99.97% |
| | C | 0.00% | 0.00% | 0.04% | 0.00% | 0.00% | 0.00% | 0.00% | 0.00% | 0.00% | 0.01% |
| | G | 0.00% | 0.01% | 0.02% | 0.23% | 0.01% | 0.02% | 0.03% | 0.06% | 0.01% | 0.02% |
| | T | 0.00% | 0.01% | 0.00% | 0.00% | 0.01% | 0.01% | 0.00% | 0.01% | 0.01% | 0.01% |

| HEK2-9 pNMG-348 | | 2<br>A | 3<br>A | 4<br>A | 5<br>A | 7<br>A | 8<br>A | 9<br>A | 10<br>A | 12<br>A | 14<br>A |
|---|---|---|---|---|---|---|---|---|---|---|---|
| | A | 99.97% | 99.97% | 99.96% | 99.85% | 99.99% | 99.99% | 99.99% | 99.96% | 99.98% | 99.94% |
| | C | 0.00% | 0.00% | 0.02% | 0.00% | 0.00% | 0.00% | 0.00% | 0.00% | 0.00% | 0.01% |
| | G | 0.01% | 0.02% | 0.02% | 0.14% | 0.01% | 0.01% | 0.01% | 0.03% | 0.00% | 0.04% |
| | T | 0.01% | 0.01% | 0.00% | 0.00% | 0.00% | 0.00% | 0.00% | 0.01% | 0.01% | 0.01% |

| HEK2-9 pNMG-349 | | 2<br>A | 3<br>A | 4<br>A | 5<br>A | 7<br>A | 8<br>A | 9<br>A | 10<br>A | 12<br>A | 14<br>A |
|---|---|---|---|---|---|---|---|---|---|---|---|
| | A | 99.98% | 99.98% | 99.62% | 99.66% | 99.97% | 99.99% | 99.99% | 99.63% | 99.98% | 99.96% |
| | C | 0.00% | 0.00% | 0.35% | 0.00% | 0.00% | 0.00% | 0.00% | 0.00% | 0.00% | 0.01% |
| | G | 0.01% | 0.01% | 0.03% | 0.34% | 0.02% | 0.01% | 0.01% | 0.37% | 0.01% | 0.03% |
| | T | 0.01% | 0.01% | 0.00% | 0.00% | 0.00% | 0.00% | 0.00% | 0.01% | 0.01% | 0.00% |

FIGURE 136

Hek2-10 site: 5'-GA$_2$A$_3$CA$_5$TA$_7$A$_8$A$_9$GA$_{11}$A$_{12}$TA$_{14}$GA$_{16}$ATGATGG-3'

| HEK2-10 pNMG-339 | | 2 A | 3 A | 5 A | 7 A | 8 A | 9 A | 11 A | 12 A | 14 A | 16 A |
|---|---|---|---|---|---|---|---|---|---|---|---|
| | A | 99.71% | 98.28% | 89.09% | 98.35% | 98.78% | 99.52% | 99.46% | 99.98% | 99.98% | 99.98% |
| | C | 0.00% | 0.00% | 0.00% | 0.00% | 0.00% | 0.00% | 0.01% | 0.00% | 0.00% | 0.00% |
| | G | 0.28% | 1.71% | 10.90% | 1.64% | 1.21% | 0.47% | 0.52% | 0.02% | 0.01% | 0.01% |
| | T | 0.01% | 0.01% | 0.01% | 0.01% | 0.01% | 0.00% | 0.01% | 0.01% | 0.01% | 0.01% |

| HEK2-10 pNMG-340 | | 2 A | 3 A | 5 A | 7 A | 8 A | 9 A | 11 A | 12 A | 14 A | 16 A |
|---|---|---|---|---|---|---|---|---|---|---|---|
| | A | 99.87% | 99.47% | 93.87% | 99.11% | 99.59% | 99.79% | 99.75% | 99.98% | 99.97% | 99.98% |
| | C | 0.00% | 0.00% | 0.00% | 0.00% | 0.00% | 0.00% | 0.01% | 0.00% | 0.00% | 0.00% |
| | G | 0.12% | 0.52% | 6.12% | 0.89% | 0.40% | 0.20% | 0.22% | 0.02% | 0.02% | 0.01% |
| | T | 0.01% | 0.01% | 0.01% | 0.00% | 0.01% | 0.01% | 0.01% | 0.01% | 0.01% | 0.01% |

| HEK2-10 pNMG-341 | | 2 A | 3 A | 5 A | 7 A | 8 A | 9 A | 11 A | 12 A | 14 A | 16 A |
|---|---|---|---|---|---|---|---|---|---|---|---|
| | A | 99.61% | 97.99% | 84.59% | 97.09% | 98.45% | 99.40% | 99.47% | 99.97% | 99.98% | 99.98% |
| | C | 0.00% | 0.00% | 0.00% | 0.00% | 0.01% | 0.00% | 0.01% | 0.00% | 0.00% | 0.00% |
| | G | 0.39% | 2.00% | 15.40% | 2.90% | 1.53% | 0.59% | 0.50% | 0.02% | 0.01% | 0.01% |
| | T | 0.01% | 0.01% | 0.01% | 0.01% | 0.01% | 0.00% | 0.01% | 0.00% | 0.01% | 0.01% |

| HEK2-10 pNMG-346 | | 2 A | 3 A | 5 A | 7 A | 8 A | 9 A | 11 A | 12 A | 14 A | 16 A |
|---|---|---|---|---|---|---|---|---|---|---|---|
| | A | 99.96% | 99.96% | 99.67% | 99.71% | 99.96% | 99.95% | 99.97% | 99.99% | 99.98% | 99.98% |
| | C | 0.00% | 0.00% | 0.00% | 0.00% | 0.00% | 0.00% | 0.02% | 0.00% | 0.00% | 0.00% |
| | G | 0.02% | 0.03% | 0.32% | 0.29% | 0.03% | 0.04% | 0.01% | 0.01% | 0.01% | 0.01% |
| | T | 0.01% | 0.01% | 0.01% | 0.00% | 0.01% | 0.01% | 0.01% | 0.01% | 0.01% | 0.01% |

| HEK2-10 pNMG-347 | | 2 A | 3 A | 5 A | 7 A | 8 A | 9 A | 11 A | 12 A | 14 A | 16 A |
|---|---|---|---|---|---|---|---|---|---|---|---|
| | A | 99.98% | 99.93% | 99.06% | 99.56% | 99.93% | 99.95% | 99.97% | 99.99% | 99.97% | 99.98% |
| | C | 0.00% | 0.00% | 0.00% | 0.00% | 0.00% | 0.00% | 0.02% | 0.00% | 0.00% | 0.00% |
| | G | 0.01% | 0.06% | 0.93% | 0.43% | 0.06% | 0.04% | 0.01% | 0.01% | 0.02% | 0.01% |
| | T | 0.01% | 0.01% | 0.01% | 0.00% | 0.01% | 0.01% | 0.01% | 0.01% | 0.01% | 0.01% |

| HEK2-10 pNMG-348 | | 2 A | 3 A | 5 A | 7 A | 8 A | 9 A | 11 A | 12 A | 14 A | 16 A |
|---|---|---|---|---|---|---|---|---|---|---|---|
| | A | 99.96% | 99.94% | 98.39% | 99.50% | 99.92% | 99.97% | 99.97% | 99.99% | 99.98% | 99.98% |
| | C | 0.00% | 0.00% | 0.00% | 0.00% | 0.00% | 0.00% | 0.02% | 0.00% | 0.00% | 0.00% |
| | G | 0.03% | 0.05% | 1.59% | 0.49% | 0.08% | 0.02% | 0.01% | 0.01% | 0.01% | 0.01% |
| | T | 0.01% | 0.01% | 0.01% | 0.01% | 0.00% | 0.00% | 0.01% | 0.01% | 0.01% | 0.01% |

| HEK2-10 pNMG-349 | | 2 A | 3 A | 5 A | 7 A | 8 A | 9 A | 11 A | 12 A | 14 A | 16 A |
|---|---|---|---|---|---|---|---|---|---|---|---|
| | A | 99.96% | 99.94% | 98.75% | 99.54% | 99.93% | 99.96% | 99.96% | 99.99% | 99.98% | 99.98% |
| | C | 0.00% | 0.00% | 0.00% | 0.00% | 0.00% | 0.01% | 0.03% | 0.00% | 0.00% | 0.00% |
| | G | 0.01% | 0.04% | 1.24% | 0.46% | 0.06% | 0.02% | 0.01% | 0.01% | 0.01% | 0.01% |
| | T | 0.01% | 0.01% | 0.01% | 0.01% | 0.00% | 0.01% | 0.01% | 0.00% | 0.01% | 0.01% |

FIGURE 137

Hek3- 5'-GGCCCA GA CTGA GCA CGTGATGG-3'
           6    8   12    15

| HEK3 pNMG-339 | 6 A | 8 A | 12 A | 15 A |
|---|---|---|---|---|
| A | 97.97% | 94.85% | 99.95% | 99.96% |
| C | 0.00% | 0.00% | 0.00% | 0.00% |
| G | 2.02% | 5.15% | 0.04% | 0.01% |
| T | 0.01% | 0.01% | 0.00% | 0.01% |

| HEK3 pNMG-346 | 6 A | 8 A | 12 A | 15 A |
|---|---|---|---|---|
| A | 99.86% | 99.76% | 99.95% | 99.98% |
| C | 0.00% | 0.00% | 0.00% | 0.00% |
| G | 0.12% | 0.23% | 0.05% | 0.01% |
| T | 0.01% | 0.01% | 0.00% | 0.01% |

| HEK3 pNMG-340 | 6 A | 8 A | 12 A | 15 A |
|---|---|---|---|---|
| A | 98.96% | 96.57% | 99.95% | 99.98% |
| C | 0.00% | 0.00% | 0.00% | 0.00% |
| G | 1.03% | 3.43% | 0.04% | 0.01% |
| T | 0.01% | 0.00% | 0.01% | 0.01% |

| HEK3 pNMG-347 | 6 A | 8 A | 12 A | 15 A |
|---|---|---|---|---|
| A | 99.73% | 99.43% | 99.96% | 99.98% |
| C | 0.00% | 0.00% | 0.00% | 0.00% |
| G | 0.26% | 0.56% | 0.03% | 0.01% |
| T | 0.01% | 0.01% | 0.01% | 0.01% |

| HEK3 pNMG-341 | 6 A | 8 A | 12 A | 15 A |
|---|---|---|---|---|
| A | 97.73% | 94.69% | 99.96% | 99.98% |
| C | 0.00% | 0.00% | 0.00% | 0.00% |
| G | 2.25% | 5.30% | 0.03% | 0.01% |
| T | 0.01% | 0.01% | 0.01% | 0.01% |

| HEK3 pNMG-348 | 6 A | 8 A | 12 A | 15 A |
|---|---|---|---|---|
| A | 99.76% | 99.62% | 99.95% | 99.98% |
| C | 0.00% | 0.00% | 0.00% | 0.00% |
| G | 0.22% | 0.37% | 0.04% | 0.00% |
| T | 0.02% | 0.01% | 0.00% | 0.01% |

| HEK3 pNMG-349 | 6 A | 8 A | 12 A | 15 A |
|---|---|---|---|---|
| A | 99.85% | 99.46% | 99.98% | 99.98% |
| C | 0.00% | 0.00% | 0.00% | 0.00% |
| G | 0.14% | 0.53% | 0.02% | 0.00% |
| T | 0.01% | 0.01% | 0.00% | 0.01% |

FIGURE 138

RNF2- 5'-GTCA TCTTA GTCA TTA CCTGAGG-3'
       4    9    13   16

| RNF2 pNMG-339 | 4 A | 9 A | 13 A | 16 A |
|---|---|---|---|---|
| A | 99.21% | 98.98% | 99.98% | 99.97% |
| C | 0.00% | 0.02% | 0.00% | 0.00% |
| G | 0.78% | 0.99% | 0.01% | 0.02% |
| T | 0.01% | 0.01% | 0.01% | 0.01% |

| RNF2 pNMG-340 | 4 A | 9 A | 13 A | 16 A |
|---|---|---|---|---|
| A | 99.75% | 99.69% | 99.99% | 99.98% |
| C | 0.00% | 0.01% | 0.00% | 0.00% |
| G | 0.24% | 0.29% | 0.01% | 0.01% |
| T | 0.01% | 0.01% | 0.01% | 0.01% |

| RNF2 pNMG-341 | 4 A | 9 A | 13 A | 16 A |
|---|---|---|---|---|
| A | 98.86% | 98.94% | 99.97% | 99.97% |
| C | 0.00% | 0.02% | 0.00% | 0.00% |
| G | 1.12% | 1.03% | 0.01% | 0.02% |
| T | 0.02% | 0.01% | 0.01% | 0.01% |

| RNF2 pNMG-346 | 4 A | 9 A | 13 A | 16 A |
|---|---|---|---|---|
| A | 99.97% | 99.94% | 99.98% | 99.98% |
| C | 0.00% | 0.02% | 0.00% | 0.00% |
| G | 0.02% | 0.04% | 0.01% | 0.01% |
| T | 0.01% | 0.01% | 0.01% | 0.01% |

| RNF2 pNMG-347 | 4 A | 9 A | 13 A | 16 A |
|---|---|---|---|---|
| A | 99.95% | 99.90% | 99.98% | 99.99% |
| C | 0.00% | 0.01% | 0.00% | 0.00% |
| G | 0.04% | 0.08% | 0.01% | 0.01% |
| T | 0.01% | 0.01% | 0.01% | 0.01% |

| RNF2 pNMG-348 | 4 A | 9 A | 13 A | 16 A |
|---|---|---|---|---|
| A | 99.93% | 99.96% | 99.97% | 99.97% |
| C | 0.00% | 0.01% | 0.00% | 0.00% |
| G | 0.06% | 0.02% | 0.01% | 0.02% |
| T | 0.01% | 0.00% | 0.01% | 0.01% |

| RNF2 pNMG-349 | 4 A | 9 A | 13 A | 16 A |
|---|---|---|---|---|
| A | 99.94% | 99.95% | 99.98% | 99.98% |
| C | 0.00% | 0.02% | 0.00% | 0.00% |
| G | 0.05% | 0.02% | 0.01% | 0.01% |
| T | 0.01% | 0.00% | 0.01% | 0.01% |

FIGURE 139

FANCF- 5'-GGA$_3$A$_4$TCCCTTCTGCA$_{15}$GCA$_{18}$CCTGG-3'

| FanCF pNMG-339 | | 3 A | 4 A | 15 A | 18 A |
|---|---|---|---|---|---|
| | A | 99.72% | 98.46% | 99.98% | 99.98% |
| | C | 0.01% | 0.01% | 0.00% | 0.00% |
| | G | 0.26% | 1.52% | 0.02% | 0.01% |
| | T | 0.01% | 0.01% | 0.00% | 0.01% |

| FanCF pNMG-346 | | 3 A | 4 A | 15 A | 18 A |
|---|---|---|---|---|---|
| | A | 99.97% | 99.85% | 99.98% | 99.98% |
| | C | 0.01% | 0.01% | 0.00% | 0.00% |
| | G | 0.01% | 0.13% | 0.02% | 0.01% |
| | T | 0.01% | 0.01% | 0.00% | 0.01% |

| FanCF pNMG-340 | | 3 A | 4 A | 15 A | 18 A |
|---|---|---|---|---|---|
| | A | 99.95% | 99.50% | 99.98% | 99.98% |
| | C | 0.01% | 0.01% | 0.00% | 0.00% |
| | G | 0.04% | 0.48% | 0.01% | 0.00% |
| | T | 0.01% | 0.00% | 0.00% | 0.01% |

| FanCF pNMG-347 | | 3 A | 4 A | 15 A | 18 A |
|---|---|---|---|---|---|
| | A | 99.95% | 99.65% | 99.98% | 99.98% |
| | C | 0.00% | 0.00% | 0.00% | 0.00% |
| | G | 0.04% | 0.34% | 0.02% | 0.00% |
| | T | 0.01% | 0.00% | 0.01% | 0.01% |

| FanCF pNMG-341 | | 3 A | 4 A | 15 A | 18 A |
|---|---|---|---|---|---|
| | A | 99.69% | 98.46% | 99.98% | 99.98% |
| | C | 0.01% | 0.01% | 0.00% | 0.00% |
| | G | 0.29% | 1.52% | 0.02% | 0.01% |
| | T | 0.01% | 0.00% | 0.00% | 0.01% |

| FanCF pNMG-348 | | 3 A | 4 A | 15 A | 18 A |
|---|---|---|---|---|---|
| | A | 99.94% | 99.08% | 99.98% | 99.98% |
| | C | 0.00% | 0.00% | 0.00% | 0.00% |
| | G | 0.05% | 0.90% | 0.01% | 0.01% |
| | T | 0.01% | 0.01% | 0.00% | 0.01% |

| FanCF pNMG-349 | | 3 A | 4 A | 15 A | 18 A |
|---|---|---|---|---|---|
| | A | 99.93% | 99.33% | 99.98% | 99.98% |
| | C | 0.01% | 0.01% | 0.00% | 0.00% |
| | G | 0.05% | 0.65% | 0.01% | 0.01% |
| | T | 0.01% | 0.01% | 0.00% | 0.01% |

Figure 141

| sgRNA | site | 107 | 108 | 109 | 142 | 144 | 177 | 335 | 370 | 371 | 402 | 464 | 476 | 477 | 478 | 482 | 484 | 492 | 497 | 498 | 500 | BE3 | BE3B | Cas9 (indel %) |
|---|---|---|---|---|---|---|---|---|---|---|---|---|---|---|---|---|---|---|---|---|---|---|---|---|
| 299 | GAACA.CAAAGCATAGACTGC | 0.2 | 0.2 | 1.0 | 0.3 | 2.9 | 14.8 | 0.4 | 62.5 | 57.7 | 54.0 | 55.8 | 62.9 | 64.0 | 61.0 | 0.7 | 33.3 | 34.1 | 45.8 | 56.5 | 29.5 | | | 23.62 |
| 299 | GAACAC.AAAGCATAGACTGC | | | | | | | | | | | | | | | | | | | | | 38.9 | 45.8 | |
| 502 | GGGGA.CGCGCTGGCTTCCCG | 0.1 | 0.0 | 0.0 | 0.1 | 0.3 | 1.2 | 0.0 | 2.0 | 3.6 | 4.0 | 3.1 | 6.1 | 5.1 | 4.9 | 0.1 | 2.7 | 4.6 | 3.3 | 4.4 | 1.3 | | | 31.98 |
| 504 | GCCA.CTTCTAAGCCCTTGAT | 0.0 | 0.0 | 0.0 | 0.0 | 0.3 | 1.3 | 0.0 | 4.3 | 21.3 | 19.2 | 15.8 | 7.2 | 5.8 | 6.0 | 0.0 | 3.8 | 4.8 | | | | | | |
| 504 | GCCACTTC.TAAGCCCTTGAT | | | | | | | | | | | | | | | | | | | | | 32.5 | 34.8 | |
| 508 | GATGA.GATAATGATGAGTCA | 0.0 | 0.0 | 0.0 | 0.1 | 0.2 | 2.7 | 0.0 | 2.5 | 3.6 | 4.2 | 3.6 | 12.9 | 13.9 | 12.1 | 0.0 | 5.4 | 8.9 | 10.1 | 12.5 | 2.6 | | | 39.19 |
| 508 | GATGAGA.TAATGATGAGTCA | 0.0 | 0.0 | 0.0 | 0.0 | 0.8 | 0.9 | 0.0 | 1.5 | 4.1 | 4.3 | 5.0 | 5.0 | 4.9 | 4.2 | 0.0 | 5.2 | 7.8 | 3.4 | 4.5 | 1.5 | | | |
| 509 | GCCTA.GGCAGTGGGGGTGCA | 0.0 | 0.0 | 0.0 | 0.0 | 0.1 | 0.4 | 0.0 | 0.7 | 1.4 | 1.5 | 1.0 | 3.8 | 5.2 | 3.2 | 0.0 | 0.3 | 1.0 | 4.0 | 3.9 | 0.9 | | | 17.16 |
| 509 | GCC.TAGGCAGTGGGGGTGCA | | | | | | | | | | | | | | | | | | | | | 9.1 | 0.3 | |
| 469 | GAGTA.TGAGGCATAGACTGC | 0.2 | 0.2 | 0.1 | 0.3 | 0.8 | 5.7 | 0.0 | 7.4 | 26.7 | 28.6 | 30.3 | 27.7 | 42.3 | 0.3 | 0.3 | 5.9 | 13.0 | 30.4 | 32.7 | 11.2 | | | |

Figure 142

| construct | HEK2 | Site 2 | site 4 | site 8 | site 9 |
|---|---|---|---|---|---|
| 107 | 0.00 | 0.01 | 0.01 | 0.06 | 0.06 |
| 108 | 0.53 | 0.18 | 0.02 | 0.02 | 0.10 |
| 109 | 0.01 | 0.03 | 0.04 | 0.05 | 0.00 |
| 142 | 0.05 | 0.01 | 0.03 | 0.13 | 0.10 |
| 144 | 0.00 | 0.07 | 0.01 | 0.02 | 0.02 |
| 177 | 0.12 | 0.12 | 0.08 | 0.03 | 0.04 |
| 335 | 0.04 | 0.03 | 0.04 | 0.00 | 0.04 |
| 370 | 0.32 | 0.09 | 0.09 | 0.01 | 0.03 |
| 371 | 0.36 | 0.17 | 0.23 | 0.09 | 0.03 |
| 402 | 0.26 | 0.16 | 0.33 | 0.00 | 0.01 |
| 404 | 0.13 | 0.17 | 0.12 | 0.11 | 0.02 |
| 476 | 0.01 | 0.14 | 0.05 | 0.00 | 0.10 |
| 477 | 0.05 | 0.10 | 0.07 | 0.09 | 0.06 |
| 478 | 0.03 | 0.20 | 0.07 | 0.03 | 0.02 |
| 482 | 0.03 | 0.16 | 0.02 | 0.09 | 0.16 |
| 494 | 0.00 | 0.11 | 0.11 | 0.08 | 0.01 |
| 492 | 0.43 |  | 0.07 | 0.02 | 0.03 |
| 497 | 0.05 |  | 0.05 | 0.07 | 0.12 |
| 498 | 0.13 |  | 0.08 | 0.05 | 0.14 |
| 500 | 0.01 |  | 0.03 | 0.05 | 0.01 |
| BE3 | 1.05 |  | 1.69 | 0.13 | 0.20 |
| BE3B | 6.34 |  | 6.90 | 0.13 | 0.18 |
| Cas9 | 28.92 |  | 31.98 | 39.19 | 17.16 |

Figure 143

| sgRNA | site | 482 | 476 | 476+274 | 476+275 | 477 | 477+274 | 477+275 | 285b | 285b+274 | 285b+275 | 277 |
|---|---|---|---|---|---|---|---|---|---|---|---|---|
| 299 | GAACAcCAAAGCATAGACTGC | 1.9 | 67.5 | 59.6 | 51.2 | 72.9 | 63.9 | 60.1 | 30.8 | 31.2 | 27.0 | 45.2 |
| 301 | GGAAcCACAAAGCATAGACTG | 0.3 | 29.5 | 23.3 | 18.5 | 37.1 | 24.6 | 32.0 | 16.9 | 14.5 | 12.5 | 19.9 |
| 301 | GGAACAcCAAAGCATAGACTG | 2.8 | 53.0 | 38.3 | 33.7 | 61.0 | 44.3 | 47.6 | 19.7 | 17.1 | 15.4 | 24.4 |
| 502 | CGGGAcCGGCTGGCTTCCCG | 0.0 | 4.1 | 4.7 | 3.6 | 3.5 | 4.1 | 3.1 | 2.7 | 2.0 | 1.3 | 1.0 |
| 505 | CGGAAcAAGACCCAGCATCCGT | 0.0 | 0.1 | 0.2 | 0.2 | 0.2 | 0.1 | 0.8 | 0.6 | 0.0 | 0.0 | 0.0 |
| 505 | CGGAAcAGACCCAGCATCCGT | 0.0 | 0.6 | 0.6 | 0.1 | 1.1 | 0.2 | 0.2 | 1.2 | 0.1 | 0.1 | 0.5 |
| 505 | CGGAAAcGACCCAGCATCCGT | 0.0 | 1.4 | 1.3 | 0.3 | 0.3 | 1.2 | 0.8 | 0.6 | 0.6 | 0.4 | 0.0 |
| 505 | CGGAAAGAcCCCAGCATCCGT | 0.7 | 3.1 | 1.3 | 1.2 | 3.2 | 1.4 | 1.9 | 0.5 | 0.1 | 0.2 | 0.6 |
| 507 | GAAAcCTGGTCCCGTTTACAG | 0.0 | 0.5 | 0.2 | 0.1 | 0.5 | 0.5 | 0.3 | | 0.5 | 0.2 | 0.3 |
| 509 | GCCTAcGGCAGTGGGGGTGCA | 0.0 | 7.7 | 2.0 | 2.0 | 5.8 | 1.7 | 2.0 | 1.3 | 0.1 | 0.7 | 0.7 |

Figure 144

| Site | Protospacer and PAM sequence | 371 | 402 | 404 | 410 | 476 | 477 | 478 | 479 | 475 |
|---|---|---|---|---|---|---|---|---|---|---|
| CAC (HeK2) | GAACACAAAGCATAGACTGCTGG | 46.4 | 46.1 | 41.0 | 46.2 | 51.8 | 39.6 | 46.9 | 35.2 | |
| AAA | GAAAAAAAGCAGAGACTGCTGG | 0.1 | 0.1 | 0.0 | 0.1 | 0.2 | 0.3 | 0.2 | 0.0 | |
| TAC | GAATACTAAGCATAGACTTCCAGG | 37.7 | 39.9 | 38.5 | 43.4 | 45.1 | 41.4 | 38.3 | 25.7 | |
| AAC | GTAAACAAAGCATAGACTGAGGG | 17.8 | 21.8 | 16.9 | 19.5 | 14.1 | 14.8 | 14.2 | 9.7 | |
| GAC | GAAGACCAAGGATAGACTGCTGG | 7.7 | 6.5 | 4.7 | 11.4 | 7.6 | 9.3 | 7.4 | 2.3 | |
| CAT | GAACATAAAGAATAGAATGATGG | 16.4 | 20.8 | 16.0 | 21.7 | 16.7 | 22.3 | 21.3 | 12.9 | |
| CAG | GGACAGGCAGCATAGACTGTGGG | 9.6 | 16.9 | 9.4 | 13.7 | 24.9 | 22.7 | 29.0 | 26.7 | |
| GAA | GTAGAAAGTATAGACTGCAGG | 2.9 | 2.8 | 2.5 | 4.8 | 8.7 | 6.4 | 6.0 | 3.7 | 11.1 |
| GAG | GGAGAGAGAGAATAGACTGCTGG | 7.6 | 10.6 | 5.6 | 10.4 | 16.5 | 26.0 | 14.1 | 9.2 | |
| GAT | GAAGATAGAGAATAGACTGCTGG | 2.6 | 4.1 | 2.2 | 6.1 | 7.1 | 7.3 | 5.6 | 3.2 | 0.5 |
| TAA | GGCTAAAGACCATAGACTGTGG | 2.3 | 3.7 | 1.8 | 2.8 | 4.2 | 5.6 | 4.1 | 2.2 | 9.8 |
| TAG | GTCTAGAAAGCTTAGACTGCTGG | 10.1 | 14.9 | 8.1 | 9.1 | 24.3 | 28.3 | 20.3 | 13.6 | 31.4 |
| TAT | GAGTATGAGGCATAGACTGCCAGG | 21.0 | 38.1 | 18.3 | 32.3 | 37.0 | 43.3 | 40.1 | 28.4 | 11.7 |
| AAG | GTCAAGAAAGCAGAGACTGCCGG | 6.1 | 6.5 | 5.6 | 10.7 | 11.9 | 12.6 | 9.8 | 7.8 | 18.7 |
| AAT | GGGAATAAATCATAGAATCCTGG | 5.9 | 11.2 | 6.4 | 16.7 | 20.1 | 15.3 | 16.0 | 11.1 | 0.3 |
| CAA | GAGCAAAGAGAATAGACTGTAGG | 2.5 | 5.4 | 2.8 | 3.2 | 7.4 | 13.3 | 6.9 | 6.2 | |

Figure 145

| Site | Protospacer and PAM sequence | Cas9 (indel %) | L84F A106V D108N H123Y D147Y E166V I195F = 3rd round | 3rd round + N37S K161T | 3rd round + D24G Q71R H96L K160E | 3rd round + H36L G67V S146T | 3rd round + Q71L L137M A143E | 3rd round + E25G Q152L | 3rd round + A91T F104I | 3rd round + N72D G125A | 3rd round + P48S S97C | 3rd round | 3rd round + A142N |
|---|---|---|---|---|---|---|---|---|---|---|---|---|---|
| HEK2 | GAACACAAAGCATAGACTGCTGG | 76.9 | 78.3 | 77.4 | 43.6 | 2.9 | 62.6 | 16.3 | 10.7 | 71.4 | 66.5 | 51.6 | 61.2 |
| HEK2-1 | GAAAAAAAGCAGAGACTGCTGG | 17.9 | 0.6 | 0.4 | 1.2 | 0.0 | 0.2 | 0.0 | 0.1 | 0.2 | 0.3 | 0.4 | 0.1 |
| HEK2-2 | GAATACTAAGCATAGACTCCAGG | 33.0 | 57.0 | 56.3 | 16.2 | 1.1 | 34.7 | 6.9 | 4.0 | 49.2 | 39.7 | 31.3 | 27.3 |
| HEK2-3 | GTAAACAAAGCATAGACTGAGGG | 43.0 | 29.5 | 31.1 | 14.8 | 0.4 | 8.7 | 1.5 | 4.2 | 17.3 | 14.1 | 13.3 | 6.0 |
| HEK2-6 | GAAGACCAAGGATAGACTGCTGG | 23.5 | 8.4 | 31.1 | 2.6 | 0.2 | 2.1 | 1.0 | 0.7 | 3.0 | 2.8 | 5.1 | |
| HEK2-10 | GAACATAAAGAATAGAATGATGG | 20.9 | 21.0 | 16.9 | 7.9 | 0.4 | 6.7 | 2.0 | 1.5 | 8.4 | 16.7 | 8.2 | 4.9 |

Figure 147

| sgRNA | site | ABE2 | ABE3 | ABE4 | ABE5-1 | ABE5-2 | ABE5-3 |
|---|---|---|---|---|---|---|---|
| 299 | GAACA₄CAAAGCATAGACTGC | 13.6 | 58.5 | 54.4 | 77.6 | 69.5 | 57.3 |
| 502 | GGGGA₆CCCGCTGGCTTCCCG | 0.9 | 5.6 | 3.0 | 5.8 | 3.0 | 3.3 |
| 504 | GCCA₄CTTCTAAGCCCTTGAT | 1.0 | 7.4 | 4.2 | 7.6 | 5.1 | 5.4 |
| 505 | GGGA₄AAGACCCAGCATCCGT | 0.1 | 0.2 | 0.7 | 0.3 | 0.1 | 0.3 |
| 505 | GGGAA₅AGACCCAGCATCCGT | 0.1 | 0.4 | 0.5 | 0.5 | 0.2 | 1.0 |
| 505 | GGGAAA₆GACCCAGCATCCGT | 0.3 | 0.6 | 0.4 | 0.2 | 0.2 | 0.5 |
| 505 | GGGAAAGA₈CCCAGCATCCGT | 0.6 | 1.5 | 1.5 | 3.0 | 1.3 | 3.6 |
| 507 | GAAA₄CTGGTCCCGTTTACAG | 0.1 | 0.6 | 0.3 | 0.9 | 0.4 | 0.6 |
| 508 | GATGA₅GATAATGATGAGTCA | 1.7 | 11.5 | 0.4 | 15.6 | 8.8 | 6.1 |
| 508 | GATGAGA₇TAATGATGAGTCA | 1.4 | 5.1 | 0.1 | 6.0 | 3.5 | 4.7 |
| 509 | GCCTA₅GGCAGTGGGGGTGCA | 0.2 | 3.1 | 0.6 | 5.9 | 2.3 | 1.3 |

Figure 149

DNA Shuffle (NeXT)

1. generated shuffled library including constructs from evo #4, 5a, 5b and evo #2
2. transformed library into S1030 + pNMG-333 selection plasmid
3. induce ABE expression for 7h and plated on selection conditions:
   a. 128 ug/mL chlor
   b. 192 ug/mL chlor
   c. 384 ug/mL spect
   d. 256 ug/mL spect, 64 ug/mL chlor
4. selection plate incubated at 37°C, 48h → surviving colonies sequenced Spect target: 5'—CAATGATGACTTCTACAGCG—3'
Chlor target: 5'—TACGGCGTAGTGCACCTGGA—3' outcome:

- >95% of clones surviving on chlor and chlor + spect plates (200 colonies sequenced total) contained Evo #3 mutations only

- clones sequenced from spect only selection condition, however, had high frequency of mutation at A142 and A143, also high frequency of mutations in C-terminal portion of ecTadA (K157, Q159, K160 and K161) – see chart on next slide

- clones sequenced from spect only selection condition had a low relative frequency of evo #3 mutations only (<10% of total constructs sequenced) – very different outcome than colonies sequenced from chlor only plates.

Figure 155:
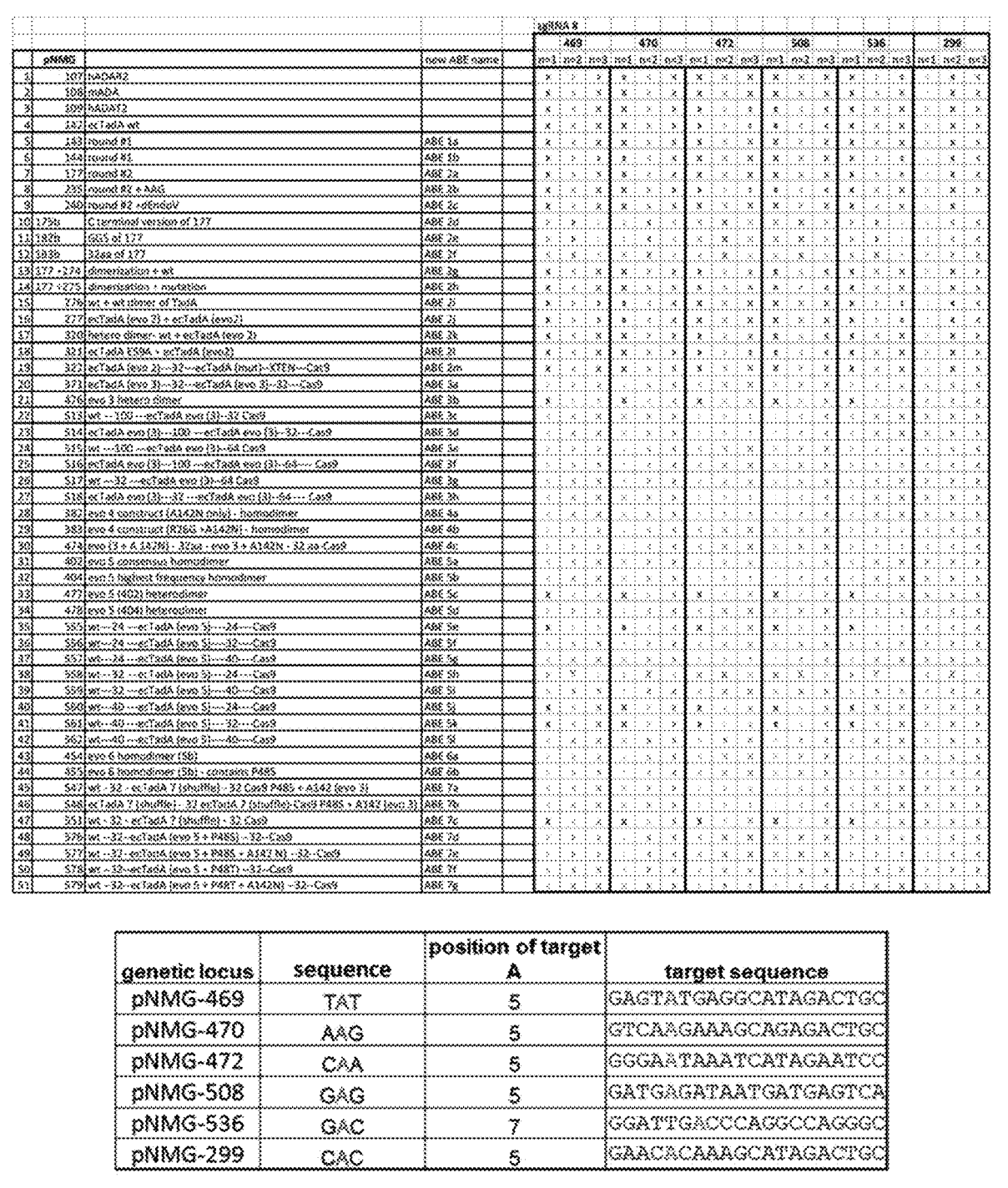

| genetic locus | sequence | position of target A | target sequence |
|---|---|---|---|
| pNMG-469 | TAT | 5 | GAGTATGAGGCATAGACTGC |
| pNMG-470 | AAG | 5 | GTCAAGAAAGCAGAGACTGC |
| pNMG-472 | CAA | 5 | GGGAATAAATCATAGAATCC |
| pNMG-508 | GAG | 5 | GATGAGATAATGATGAGTCA |
| pNMG-536 | GAC | 7 | GGATTGACCCAGGCCAGGGC |
| pNMG-299 | CAC | 5 | GAACACAAAGCATAGACTGC |

Correction of: 5'-TTCATTA(7)ACTGTGGCCGGCT-3'
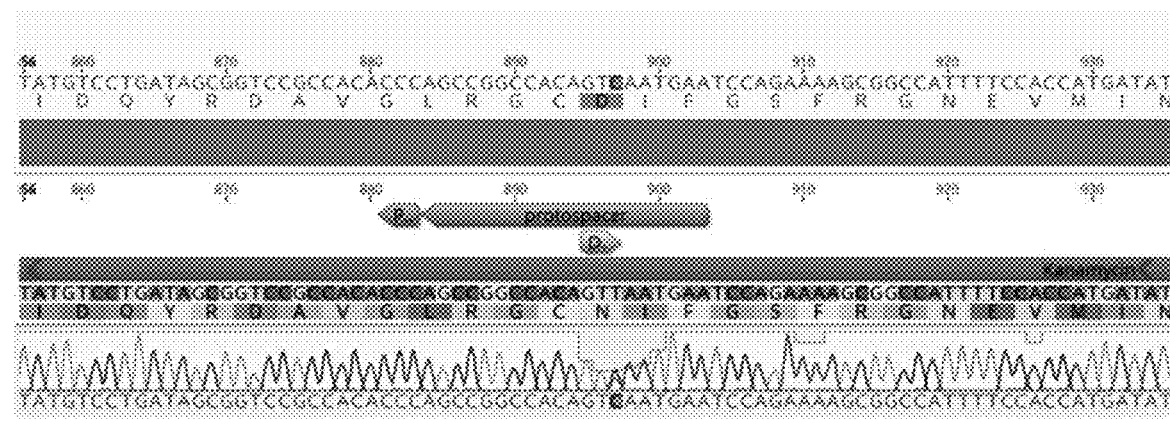
Correction of: 5'-ATCTTA(6)TTCGATCATGCGAA-3'
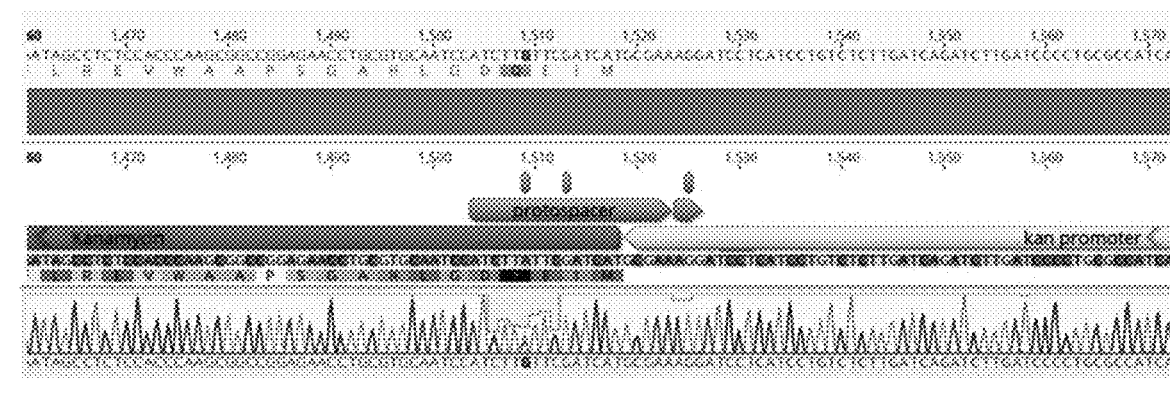
Figure 163

| position: | 17 | 23 | 48 | 111 | 118 | 122 | 123 | 125 | 126 | 147 | 152 | 155 | 156 | 161 | 164 |
|---|---|---|---|---|---|---|---|---|---|---|---|---|---|---|---|
| wt res: | Thr | Trp | Pro | Thr | Met | His | His | Gly | Met | Asp | Arg | Glu | Ile | Lys | Ser |
| | Ser | Leu | Ala | | | | | | | | | | | | |
| | | | Ala | | | Asn | | | | | | | | | |
| | | | Ala | Ser | | | | | | | | | | | |
| | Ser | | Ala | | | | | | | | | | | Thr | Tyr |
| | | | Ser | | | | | | | | | | | | |
| | | | Ser | | | | | | | | Pro | | | | |
| | | | Ala | | | | | Leu | | | | | | Thr | |
| | Ser | Leu | Ser | | | | | | | | | | | Thr | |
| | | | Ala | | | | | Leu | | | | | | Thr | |
| | | Leu | Ala | | | | | | | | | | | Thr | |
| | | | | | Leu | | | | | | | | | | |
| | Ser | Leu | Ala | | | | | | | | | | | | |
| | | | Ala | | | | | | | | His | | | Thr | |
| | | | Ala | | | | | | | | Pro | | | | |
| | Ser | Leu | Ala | | | | Ala | | | | | | | Thr | |
| | Ser | Leu | Ala | | | | | | | | | | | Thr | |
| | | | | | | | | | | | Pro | | | Asn | |
| | | | Ala | | | | | | | | Pro | | | | |
| | | | Ala | | | | | | | | | | | | |
| | | Arg | Ala | | | | | | | | | | | | |

| sgRNA plasmid | protospacer | %editing | ABE | cell line |
|---|---|---|---|---|
| pNMG-510 | GACTCAGATAAGATGCTGAGG | <0.15% | pNMG-478 | R196* TP53 (Calu-6) |
| pNMG-511 | GCATATGTAACAGTTCCTGCA | <0.80% | pNMG-402 | M237I TP53 (T98G) |
| pNMG-512 | GTGCATGTTTGTGCCTGTCC | <0.13% | pNMG-477 | R273H TP53 (NCI-H1975) |

| Site | Protospacer and PAM sequence | Evo Round #2 (in cis homodimer) | Evo Round #3 (in cis homodimer) | Evo Round #4 A142N (in cis homodimer) | Evo Round #4 R259G +A142N (in cis homodimer) | Evo Round #4 R259G +R107H +A142N +A143D (in cis homodimer) | Evo Round #4 A142N (in trans heterodimer) | Evo Round #4 R259G +A142N (in trans heterodimer) | Evo Round #4 R259G +R107H +A142N +A143D (in trans heterodimer) |
|---|---|---|---|---|---|---|---|---|---|
| HEK2 | GAACACAAAGCATAGACTGCTGG | 54.0 | 65.4 | 48.4 | 52.9 | 40.3 | 23.9 | 23.4 | 17.7 |
| HEK2-2 | GAATACTAAGCATAGACTCCAGG | 29.1 | 50.1 | 24.5 | 23.8 | 11.3 | 10.5 | 13.9 | 8.3 |
| HEK2-3 | GTAAACAAAGCATAGACTGAAGG | 10.4 | 20.1 | 8.2 | 11.0 | 3.5 | 3.1 | 3.9 | 2.2 |
| HEK2-6 | GAAGACCAAGGATAGACTGCTGG | 4.4 | 7.6 | 4.6 | 5.5 | 1.4 | 1.2 | 1.3 | 0.6 |
| HEK2-7 | GAAAACAAATCATTGACTGCAGG | 0.3 | 0.7 | 0.3 | 0.2 | 0.1 | 0.1 | 0.1 | 0.0 |
| HEK2-10 | GAACATAAAGAATAGAATGATGG | 6.3 | 21.4 | 3.6 | 6.3 | 2.0 | 1.5 | 1.1 | 0.7 |

*In cis* homodimer

*In trans* heterodimer

Figure 170

| Site | Protospacer and PAM sequence | Evo Round #5 (in cis homodimer) | 402 | 403 | 404 | 405 | 406 | 407 | 408 | 409 | 410 | 411 | 412 |
|---|---|---|---|---|---|---|---|---|---|---|---|---|---|
| HEK2 | GAACACAAAGCATAGACTGCTGG | 54.7 | 64.9 | 50.3 | 72.4 | 66.9 | 58.9 | 64.0 | 49.3 | 52.5 | 54.5 | 58.9 | 59.4 |
| HEK2 GSQ | GAACACAATGCATAGATTGCTGG | 18.6 | 36.9 | 24.1 | 33.9 | 29.5 | 27.6 | 28.0 | 15.5 | 16.2 | 28.2 | 28.2 | 32.1 |
| HEK2-1 | GAAAAAAGCAGAGACTGCTGG | 0.2 | 0.3 | 0.2 | 0.4 | 0.4 | 0.4 | 0.9 | 0.2 | 0.1 | 0.2 | 0.4 | 0.5 |
| HEK2-2 | GAATACTAAGCATAGACTCCAGG | 29.0 | 44.2 | 30.2 | 40.7 | 38.4 | 31.7 | 35.9 | 28.5 | 26.4 | 35.6 | 41.5 | 18.3 |
| HEK2-3 | GTAACAAAGCATAGACTGAAGG | 14.7 | 15.8 | 10.8 | 14.1 | 14.3 | 11.6 | 18.3 | 14.4 | 8.9 | 14.2 | 16.3 | 37.0 |
| HEK2-4 | GGACACAAAGCTTAGACTCCAGG | 32.7 | 41.7 | 33.6 | 41.5 | 39.8 | 33.1 | 31.2 | 35.7 | 29.6 | 34.8 | 38.0 | 3.8 |
| HEK2-6 | GAAGACCAAGGATAGACTGCTGG | 4.3 | 6.0 | 5.5 | 4.4 | 1.3 | 7.5 | 7.9 | 3.5 | 4.6 | 7.0 | 6.5 | 1.0 |
| HEK2-7 | GAAAACAAATCATTGACTGCAGG | 0.6 | 1.0 | 1.0 | 1.3 | 1.3 | 1.0 | 1.8 | 0.7 | 0.9 | 0.9 | 1.5 | 32.9 |
| HEK2-8 | GATCACAAAGCATGGACTGAAGG | 25.9 | 37.7 | 25.3 | 36.8 | 32.5 | 26.3 | 29.3 | 25.0 | 26.7 | 36.4 | 36.8 | 13.9 |
| HEK2-10 | GAACATAAAGAATAGAATGATGG | 11.2 | 14.8 | 14.3 | 11.9 | 11.3 | 11.1 | 20.5 | 9.2 | 9.1 | 14.4 | 16.2 | 13.9 |

Round #5a constructs

```
HEK2: GAACACAAAGCATAGACTGCGGG
AAA:  GAAAAAAAAGCAGAGACTGCTGG
TAC:  GAATACTAAGCATAGACTCCAGG
AAC:  GTAAACAAAGCATAGACTGAGGG
GAC:  GAAGACCAAGGATAGACTGCTGG
CAT:  GAACATAAAGAATAGAATGATGG

GAG:  GGAGAGAGCATAGACTGCTGG
GAT:  GAAGATAGAGAATAGACTGCTGG
GAA:  GTAGAAAAAGTATAGACTGCAGG
AAG:  GTCAAGAAAGCAGAGACTGCCGG
TAT:  GAGTATGAGGCATAGACTGCAGG
TAG:  GTCTAGAAAGCTTAGACTGCTGG
CAG:  GGACAGGCAGCATAGACTGTGGG
CAA:  GAGCAAAGAGAATAGACTGTAGG
TAA:  GGCTAAAGACCATAGACTGTGGG
AAT:  GGGAATAAATCATAGAATCCTGG
```

Figure 178 sgRNA 299: 5'-GAACACAAAGCATAGACTGC-3' sgRNA 469: 5'- GAGTATGAGGCATAGACTGC-3' sgRNA 472: 5'-GAGCAAAGACAATACACTGT-3' sgRNA 508: 5'-GATGAGATAATGATGAGTCA-3' sgRNA 536: 5'-GGATTGACCCAGGCCAGGGC-3'

ADENOSINE NUCLEOBASE EDITORS AND USES THEREOF

RELATED APPLICATIONS

This application is a continuation of and claims priority under 35 U.S.C. § 120 to U.S. patent application U.S. Ser. No. 15/791,085, filed Oct. 23, 2017, which claims priority under 35 U.S.C. § 120 and 365(c) to and is a continuation of international PCT Application, PCT/US2017/045381, filed Aug. 3, 2017, which claims priority under 35 U.S.C. § 119(e) to U.S. Provisional applications, U.S. Ser. No. 62/473,714, filed Mar. 20, 2017, U.S. Ser. No. 62/454,035, filed Feb. 2, 2017, and U.S. Ser. No. 62/370,684, filed Aug. 3, 2016, each of which is incorporated herein by reference.

BACKGROUND OF THE INVENTION

Targeted editing of nucleic acid sequences, for example, the targeted cleavage or the targeted introduction of a specific modification into genomic DNA, is a highly promising approach for the study of gene function and also has the potential to provide new therapies for human genetic diseases. Since many genetic diseases in principle can be treated by effecting a specific nucleotide change at a specific location in the genome (for example, an A to G or a T to C change in a specific codon of a gene associated with a disease), the development of a programmable way to achieve such precise gene editing represents both a powerful new research tool, as well as a potential new approach to gene editing-based therapeutics.

SUMMARY OF THE INVENTION

Provided herein are compositions, kits, and methods of modifying a polynucleotide (e.g., DNA) using an adenosine deaminase and a nucleic acid programmable DNA binding protein (e.g., Cas9) Some aspects of the disclosure provide nucleobase editing proteins which catalyze hydrolytic deamination of adenosine (forming inosine, which base pairs like guanine (G)) in the context of DNA. There are no known naturally occurring adenosine deaminases that act on DNA. Instead, known adenosine deaminases act on RNA (e.g., tRNA or mRNA). To overcome this drawback, the first deoxyadenosine deaminases were evolved to accept DNA substrates and deaminate deoxyadenosine (dA) to deoxyinosine. The adenosine deaminase acting on tRNA (ADAT) from *Escherichia coli* (TadA, for tRNA adenosine deaminase A), was covalently fused to a dCas9 domain, and libraries of this fusion were assembled containing mutations in the deaminase portion of the construct. It should be appreciated that *E. coli* TadA (ecTadA) deaminases also include truncations of ecTadA. For example, truncations (e.g., N-terminal truncations) of a full length ecTadA (SEQ ID NO: 84), such as the N-terminally truncated ecTadA set forth in SEQ ID NO: 1 are provided herein for use in the present invention. Further, it was found that other adenosine deaminase mutants, such as *S. aureus* TadA mutants, were capable of deaminating adenosine. Without wishing to be bound by any particular theory, truncations of adenosine deaminases (e.g., ecTadA) may have desired solubility and/or expression properties as compared to their full-length counterparts.

Mutations in the deaminase domain of nucleobase editing proteins were made by evolving adenosine deaminases. Productive variants were identified via selection for A to G reversion at the codon of an active-site His in the acetyl-transferase gene of chloramphenicol (encoded on a co-transformed selection plasmid). A first round of evolution yielded an ecTadA variant, ecTadA D108X (X=G, V, or N), capable of converting A to G in DNA. In some embodiments, the ecTadA variant comprises a D108A mutation in SEQ ID NO: 1, or a corresponding mutation in another adenosine deaminase. The first round of evolution also yielded an ecTadA variant, ecTadA A106V. A subsequent round of evolution resulted in another variant, ecTadA D108N_E155X (X=G, V, or D), which *E. coli* survive in the presence of high concentrations of chloramphenicol. Additional variants were identified by evolving ecTadA. For example, ecTadA variants that are capable of deaminating adenosine in DNA include one or more of the following mutations D108N, A106V, D147, E155V, L84F, H123Y, and I157F of SEQ ID NO: 1. It should be appreciated however, that homologous mutations may be made in other adenosine deaminases to generate variants that are capable of deaminating adenosine in DNA. Additional rounds of evolution provided further ecTadA variants. For example, additional ecTadA variants are shown in FIGS. 11, 16, 97, 104-106, 125-128, 115 and Table 4.

In the examples provided herein, exemplary nucleobase editors having the general structure evolved ecTadA (D108X; X=G, V, or N)-XTEN-nCas9, catalyzed A to G transition mutations in cells such as eukaryotic cells (e.g., Hek293T mammalian cells). In other examples exemplary nucleobase editors contain two ecTadA domains and a nucleic acid programmable DNA binding protein (napDNAbp). For example nucleobase editors may have the general structure ecTadA(D108N)-ecTadA(D108N)-nCas9. Additional examples of nucleobase editors containing ecTadA variants provided herein demonstrate an improvement in performance of the nucleobase editors in mammalian cells. For example, certain adenosine base editors include ecTadA having D108X, where X=G, V, or N, and/or E155X, where X=B, V, or D mutations in ecTadA as set forth in SEQ ID NO: 1 or another adenine deaminase. In certain embodiments mutants, nucleobase editors are covalently fused to catalytically dead alkyl adenosine gylcosylase (AAG), which may protect the edited inosine from base excision repair (or other DNA repair systems) until the T on the opposite strand is changed to a C, for example, through mismatch repair (or other DNA repair systems). Once the base opposite the inosine is changed to a C, then the inosine may be changed to a G irreversibly and permanently through cellular DNA repair processes, resulting in a permanent change from an A:T base pair to a G:C base pair.

Without wishing to be bound by any particular theory, the adenosine nucleobase editors described herein work by using ecTadA variants to deaminate A bases in DNA, causing A to G mutations via inosine formation. Inosine preferentially hydrogen bonds with C, resulting in A to G mutation during DNA replication. When covalently tethered to Cas9 (or another nucleic acid programmable DNA binding protein), the adenosine deaminase (e.g., ecTadA) is localized to a gene of interest and catalyzes A to G mutations in the ssDNA substrate. This editor can be used to target and revert single nucleotide polymorphisms (SNPs) in disease-relevant genes, which require A to G reversion. This editor can also be used to target and revert single nucleotide polymorphisms (SNPs) in disease-relevant genes, which require T to C reversion by mutating the A, opposite of the T, to a G. The T may then be replaced with a C, for example by base excision repair mechanisms, or may be changed in subsequent rounds of DNA replication.

Some aspects of the disclosure relate to the discovery that engineered (e.g., evolved) adenosine deaminases are capable of deaminating adenosine in a deoxyribonucleic acid (DNA) substrate. In some embodiments, the disclosure provides such adenosine deaminases. In some embodiments, the adenosine deaminases provided herein are capable of deaminating an adenosine in a DNA molecule. Other aspects of the disclosure provide fusion proteins comprising a Cas9 domain and an adenosine deaminase domain, for example, an engineered deaminase domain capable of deaminating an adenosine in DNA. In some embodiments, the fusion protein comprises one or more of a nuclear localization sequence (NLS), an inhibitor of inosine base excision repair (e.g., dISN), and/or a linker.

In some aspects, the disclosure provides an adenosine deaminase capable of deaminating an adenosine in a deoxyribonucleic acid (DNA) substrate. In some embodiments, the adenosine deaminase is from a bacterium, for example, *E. coli* or *S. aureus*. In some embodiments, the adenosine deaminase is a TadA deaminase. In some embodiments, the TadA deaminase is an *E. coli* TadA deaminase (ecTadA). In some embodiments, the adenosine deaminase comprises a D108X mutation in SEQ ID NO: 1, or a corresponding mutation in another adenosine deaminase, wherein X is any amino acid other than the amino acid found in the wild-type protein. In some embodiments, X is G, N, V, A, or Y.

In some embodiments, the adenosine deaminase comprises a E155X mutation in SEQ ID NO: 1, or a corresponding mutation in another adenosine deaminase, wherein X is any amino acid other than the amino acid found in the wild-type protein. In some embodiments, X is D, G, or V. It should be appreciated that the adenosine deaminases provided herein may contain one or more of the mutations provided herein in any combination.

Some aspects of the disclosure provide a fusion protein comprising: (i) a Cas9 domain, and (ii) an adenosine deaminase, such as any of the adenosine deaminases provided herein. In some embodiments, the Cas9 domain of the fusion protein is a nuclease dead Cas9 (dCas9), a Cas9 nickase (nCas9), or a nuclease active Cas9. In some embodiments, the fusion protein further comprises an inhibitor of inosine base excision repair, for example a dISN or a single stranded DNA binding protein. In some embodiments, the fusion protein comprises one or more linkers used to attach an adenine deaminase (e.g., ecTadA) to a nucleic acid programmable DNA binding protein (e.g., Cas9). In some embodiments, the fusion protein comprises one or more nuclear localization sequences (NLS).

The summary above is meant to illustrate, in a non-limiting manner, some of the embodiments, advantages, features, and uses of the technology disclosed herein. Other embodiments, advantages, features, and uses of the technology disclosed herein will be apparent from the Detailed Description, the Drawings, the Examples, and the Claims.

BRIEF DESCRIPTION OF THE DRAWINGS

FIG. 12 shows the colony forming units (C.F.U.) of various constructs challenged on increasing concentrations of chloramphenicol. The construct numbers correspond to those listed in FIG. 11.

FIG. 15 is a schematic showing the development of ABE.

FIG. 16 is a table showing the results of clones assayed after second round evolution. Columns 1, 8, and 10 represent mutations from the first round evolution. Columns 11 and 14 represent the consensus mutations from second round evolution.

Figure 21:
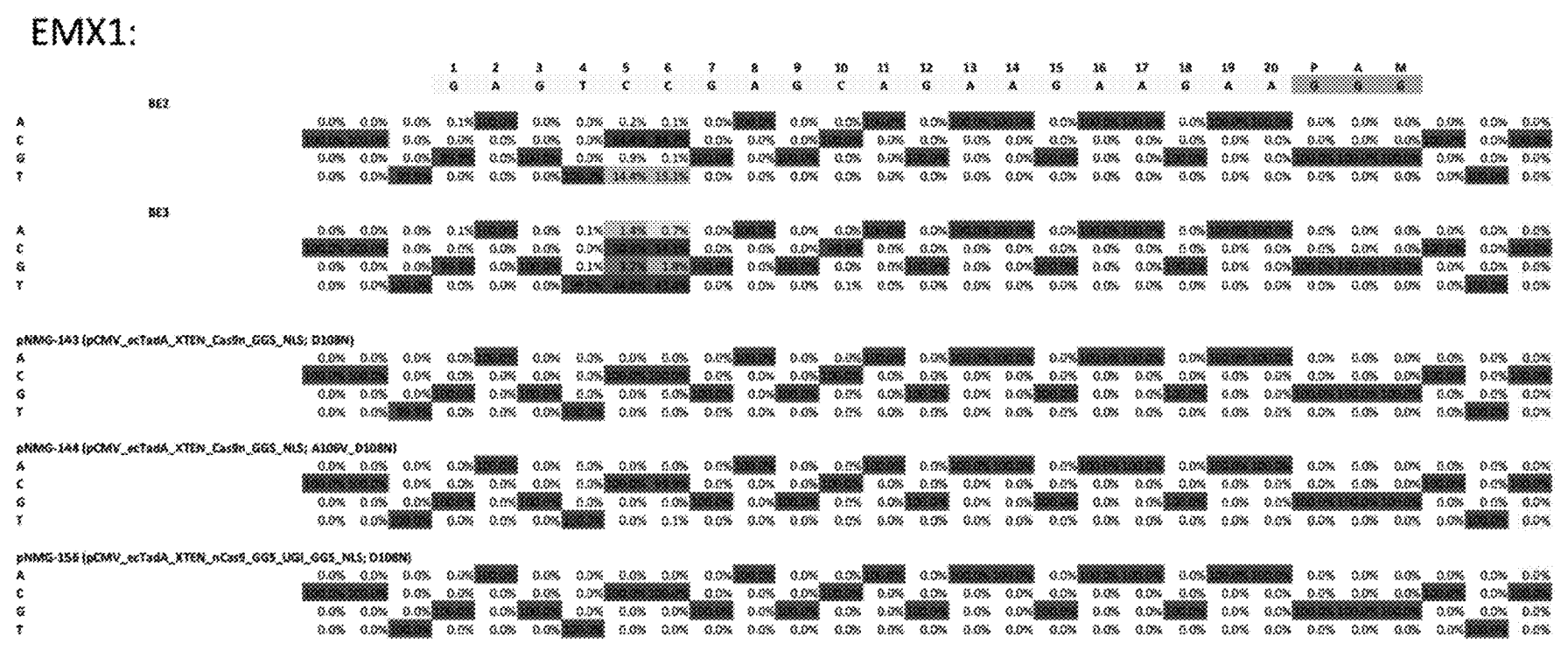

FIG. 21 shows that ABE operates best on 1 of 6 genomic sites tested. The sequence corresponds to SEQ ID NO: 46.

Figure 22:
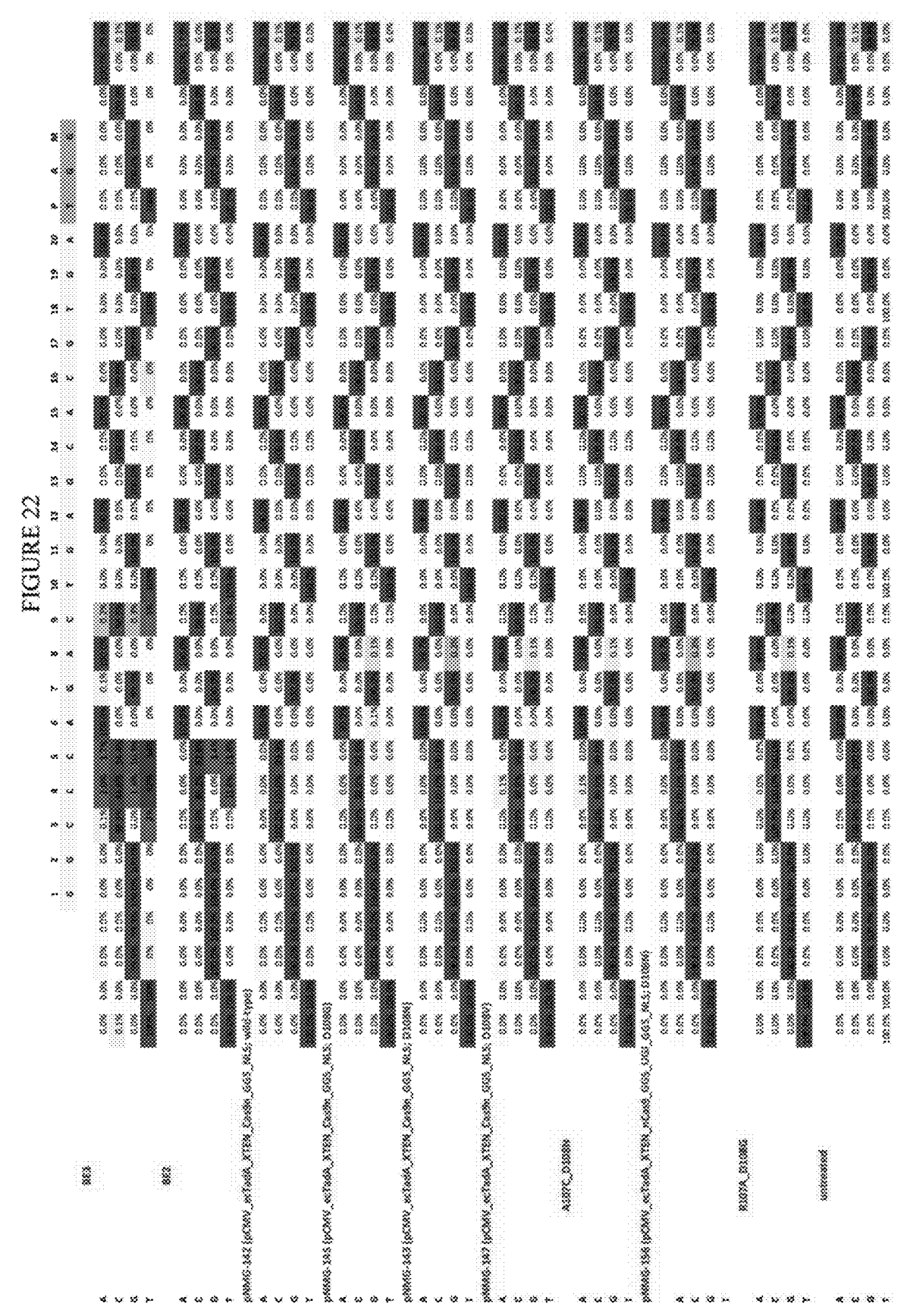

FIG. 22 shows that the Hek-3 site also has lower editing relative to the Hek-2 site editing at position 8 of the protospacer. The sequence corresponds to SEQ ID NO: 42.

FIG. 24 shows inactive C-terminal Cas9 fusions of ecTadA for pNMG-174 through pNMG-177. The sequence corresponds to SEQ ID NO: 41.

FIG. 25 shows the editing results from ecTadA nucleobase editors (pNMG-143, pNMG-144, pNMG-164, and pNMG-177). The sequence corresponds to SEQ ID NO: 41.

FIG. 26 shows the editing results from ecTadA nucleobase editors (pNMG-164, pNMG-177, pNMG-178, pNMG-179, and pNMG-180). The sequence corresponds to SEQ ID NO: 41.

FIG. 27 shows the results of editing at the Hek-3 site. The sequence corresponds to SEQ ID NO: 42.

Figure 28:
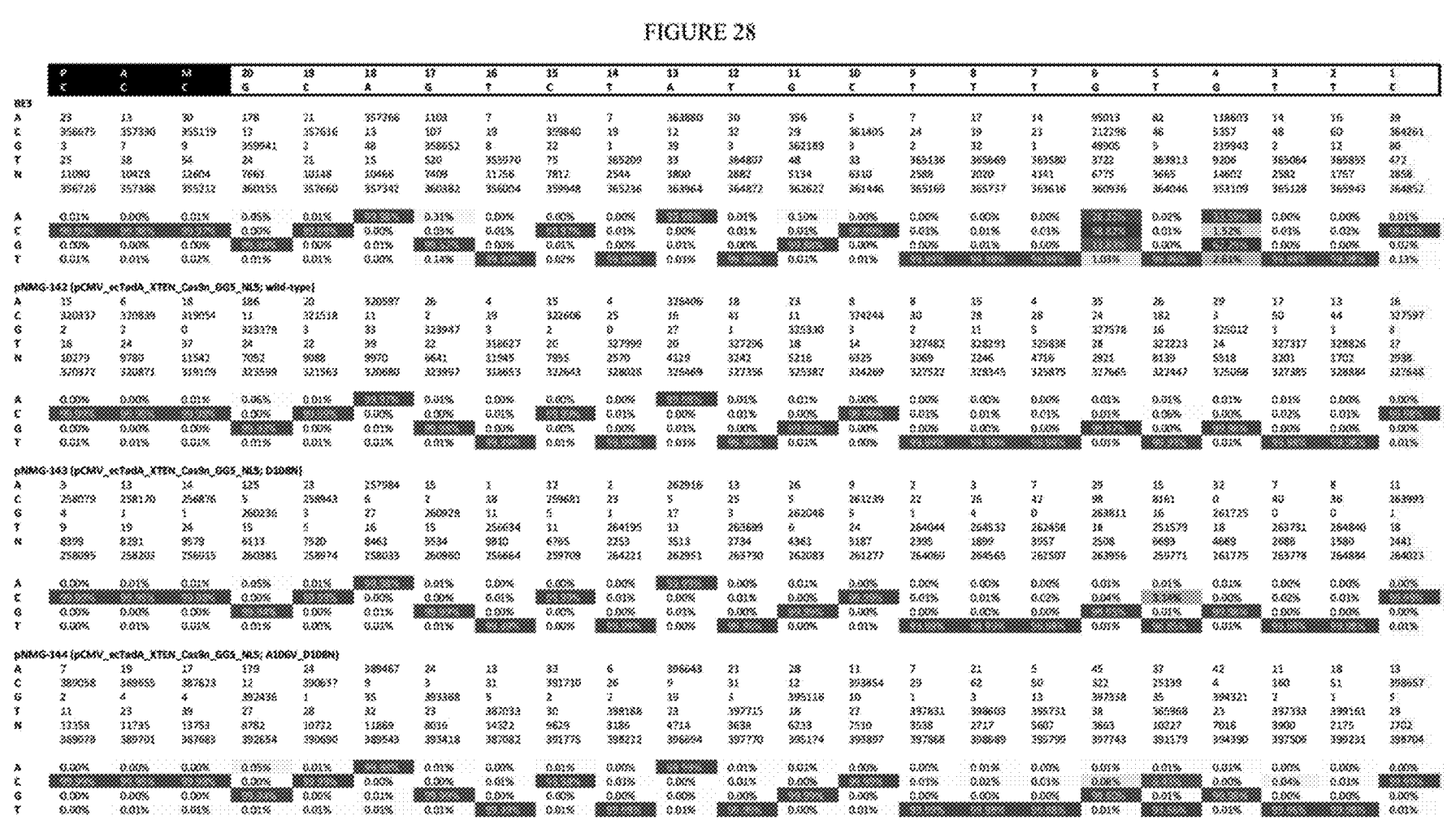
Figure 28:
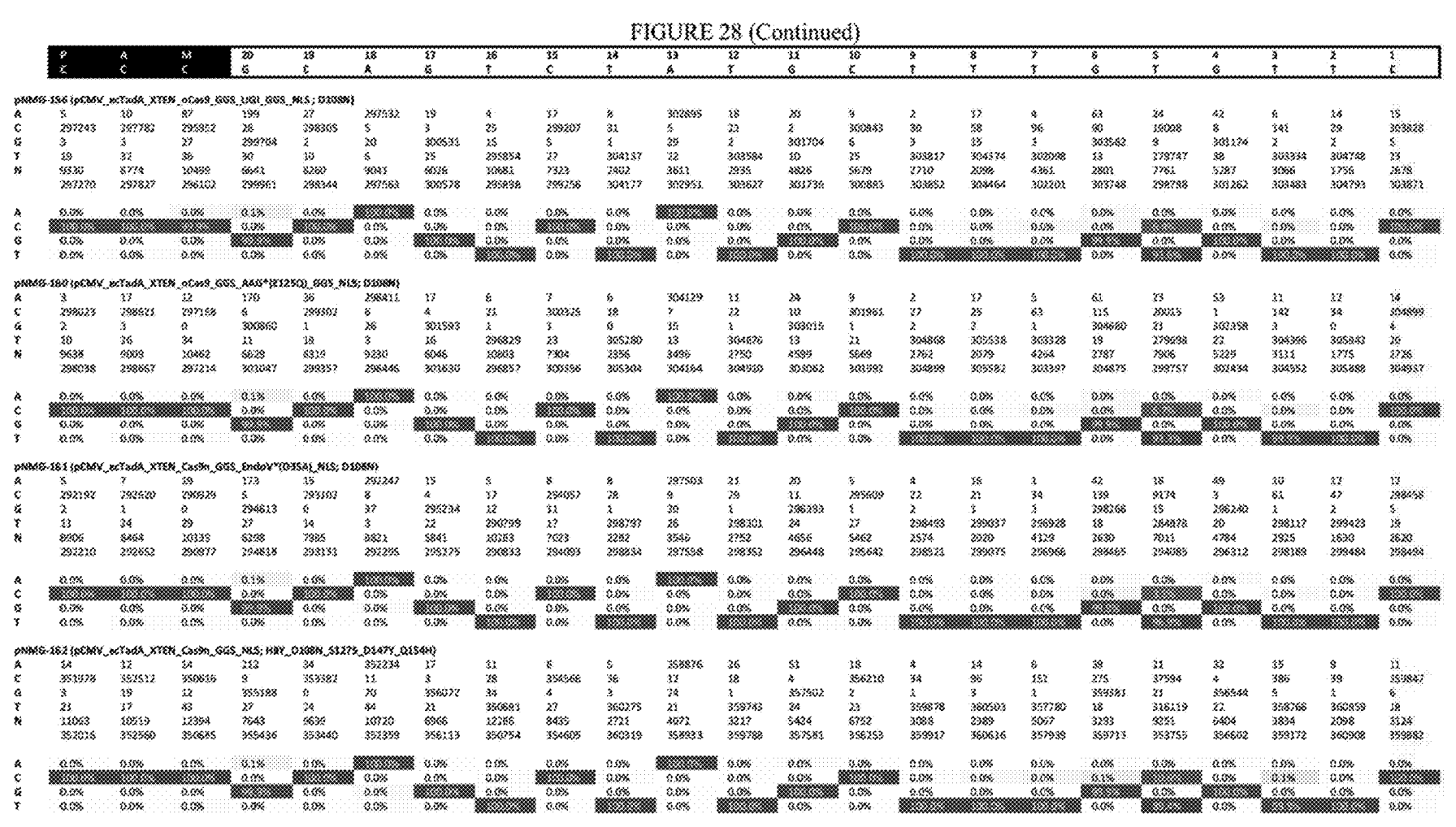
Figure 28:
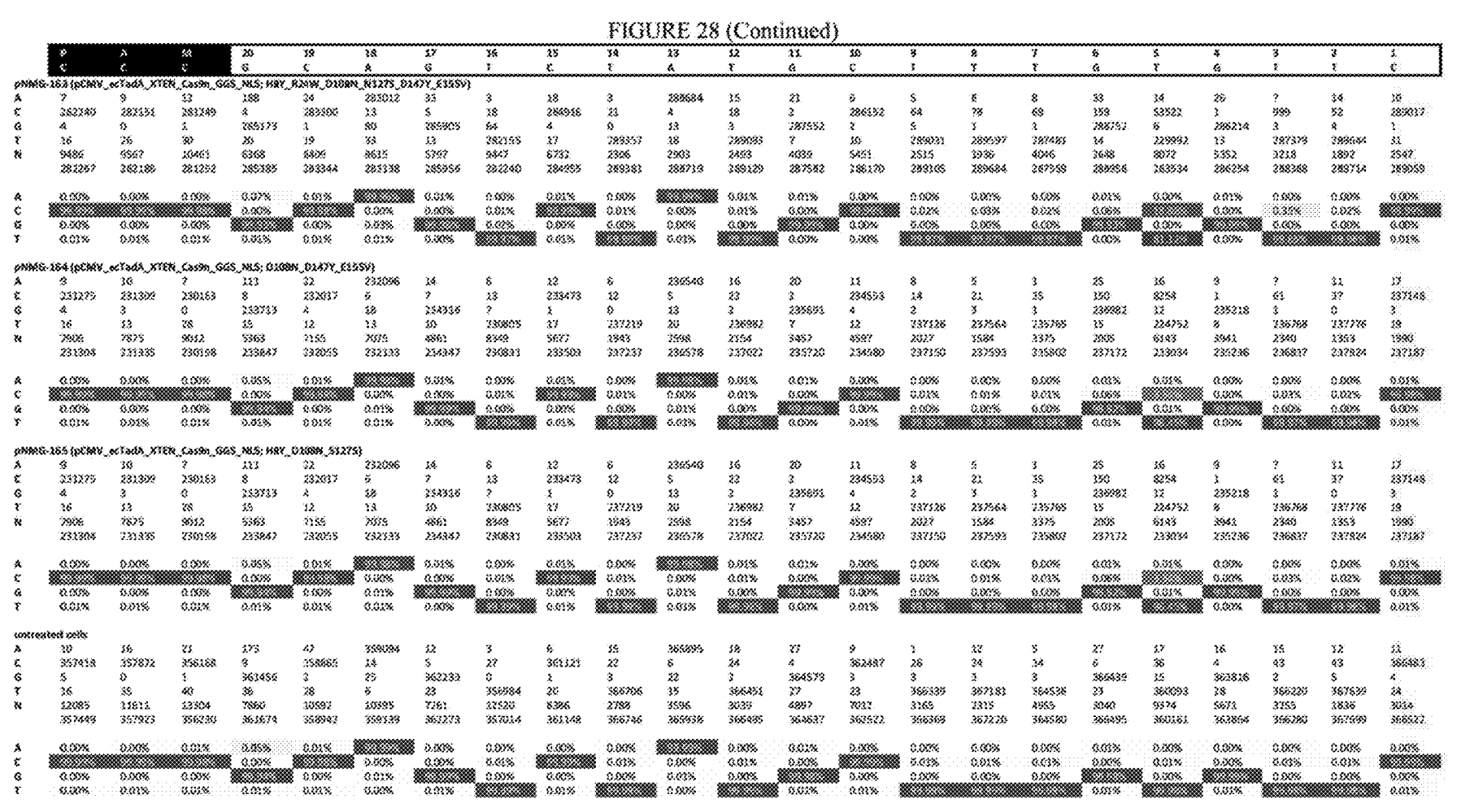

FIG. 28 shows the results of editing at the Hek-2 site. The sequence corresponds to SEQ ID NO: 41.

Figure 29:
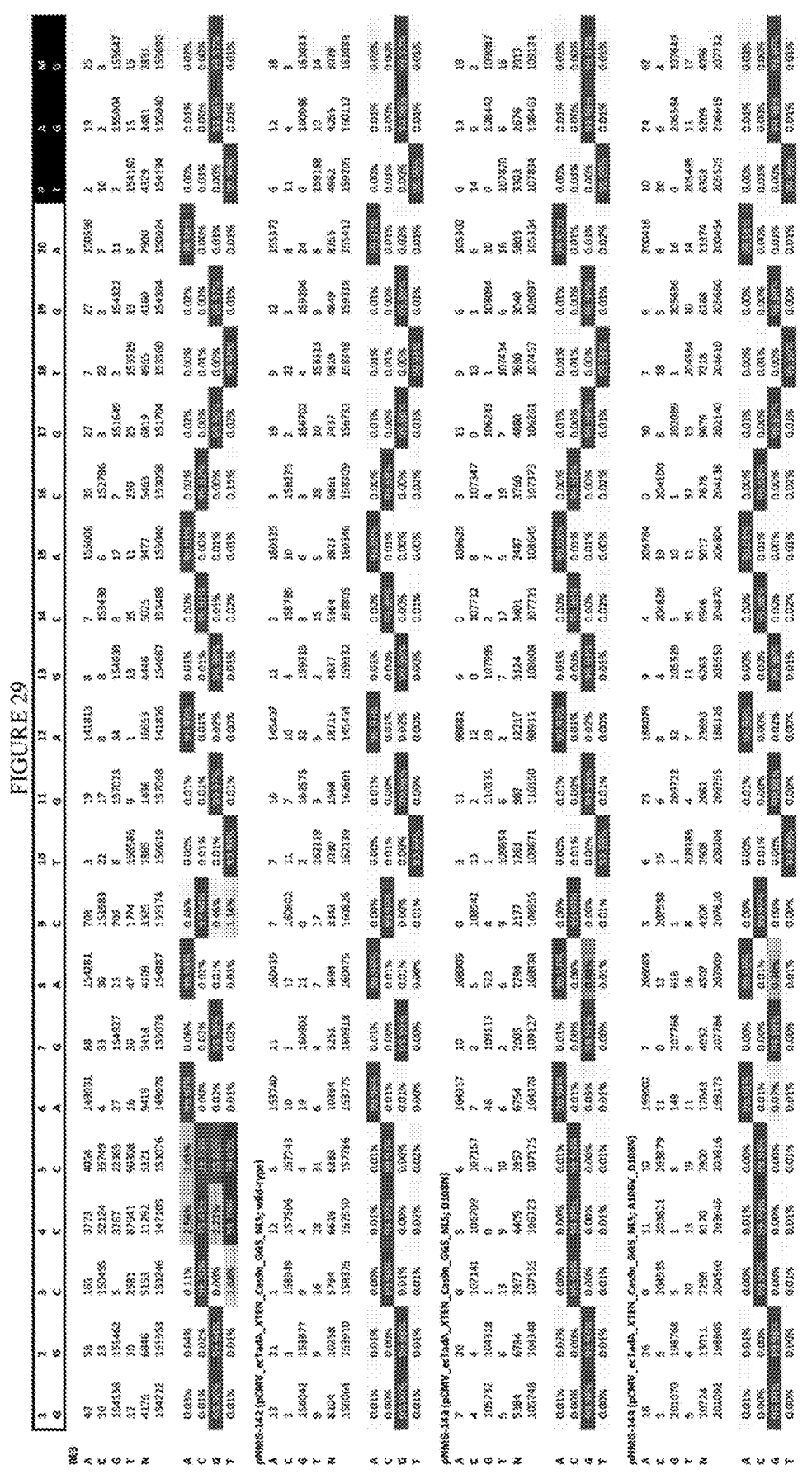
Figure 29:
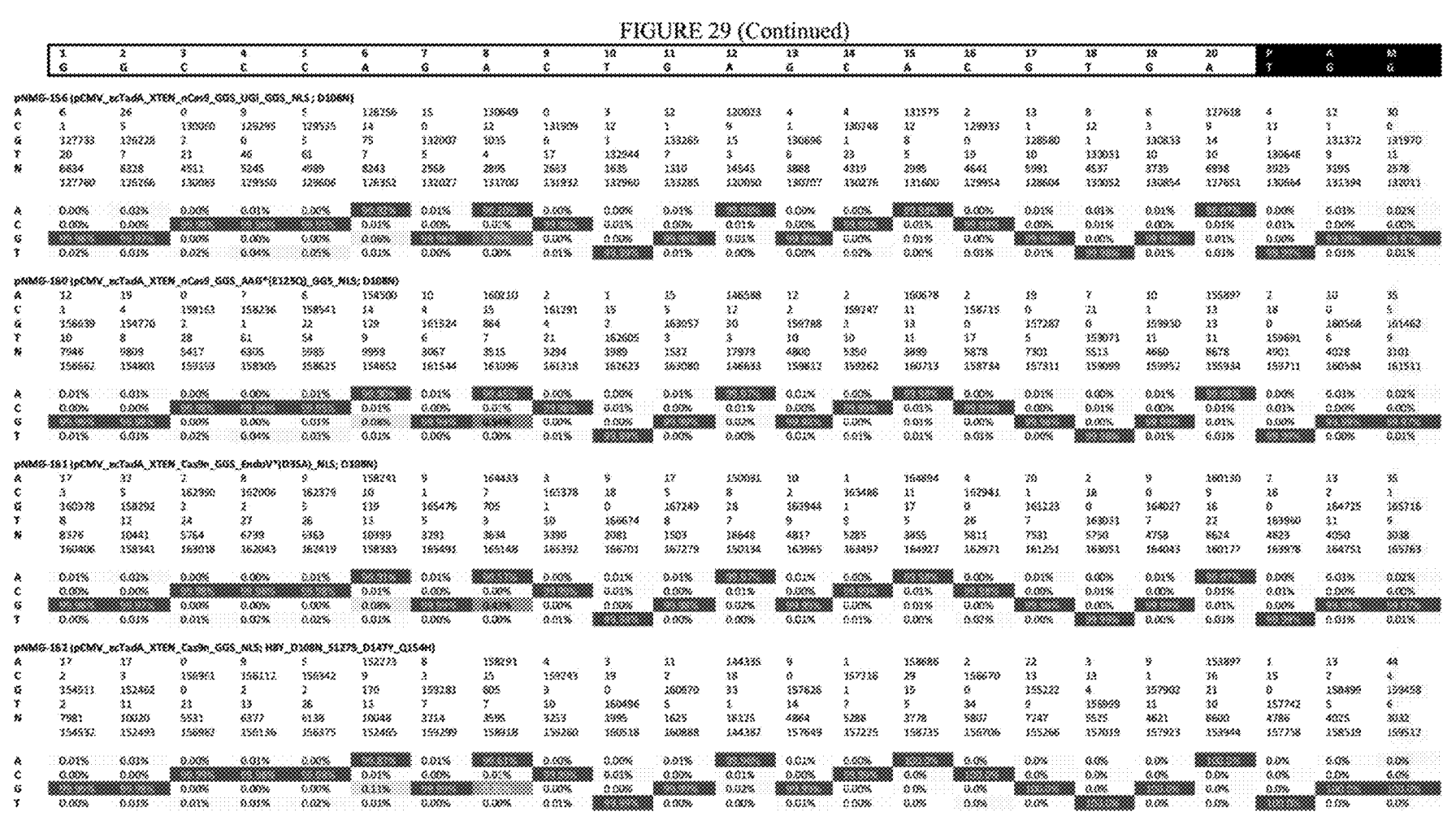
Figure 29:
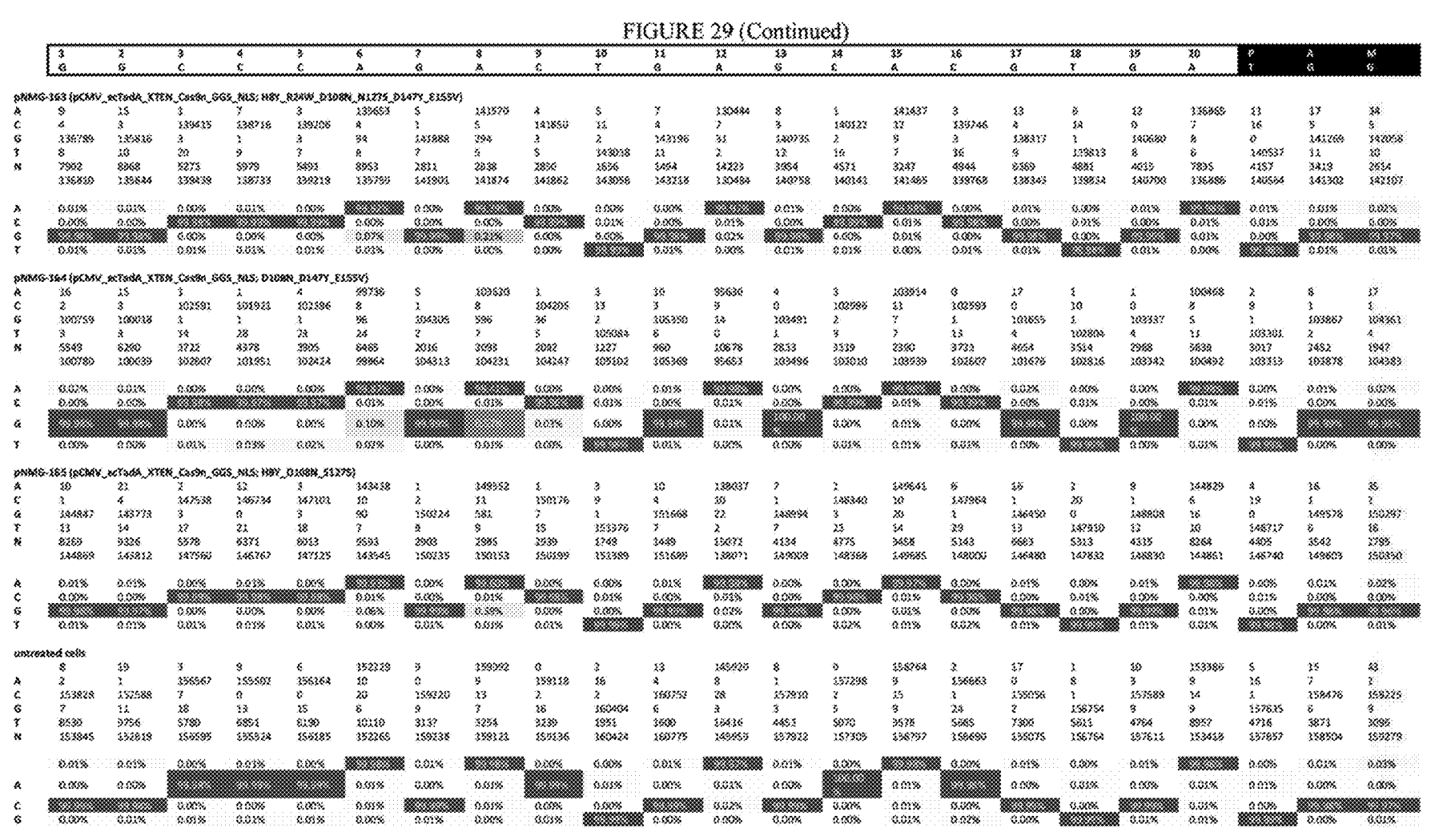

FIG. 29 shows the results of editing at the Hek-3 site. The sequence corresponds to SEQ ID NO: 42.

Figure 30:
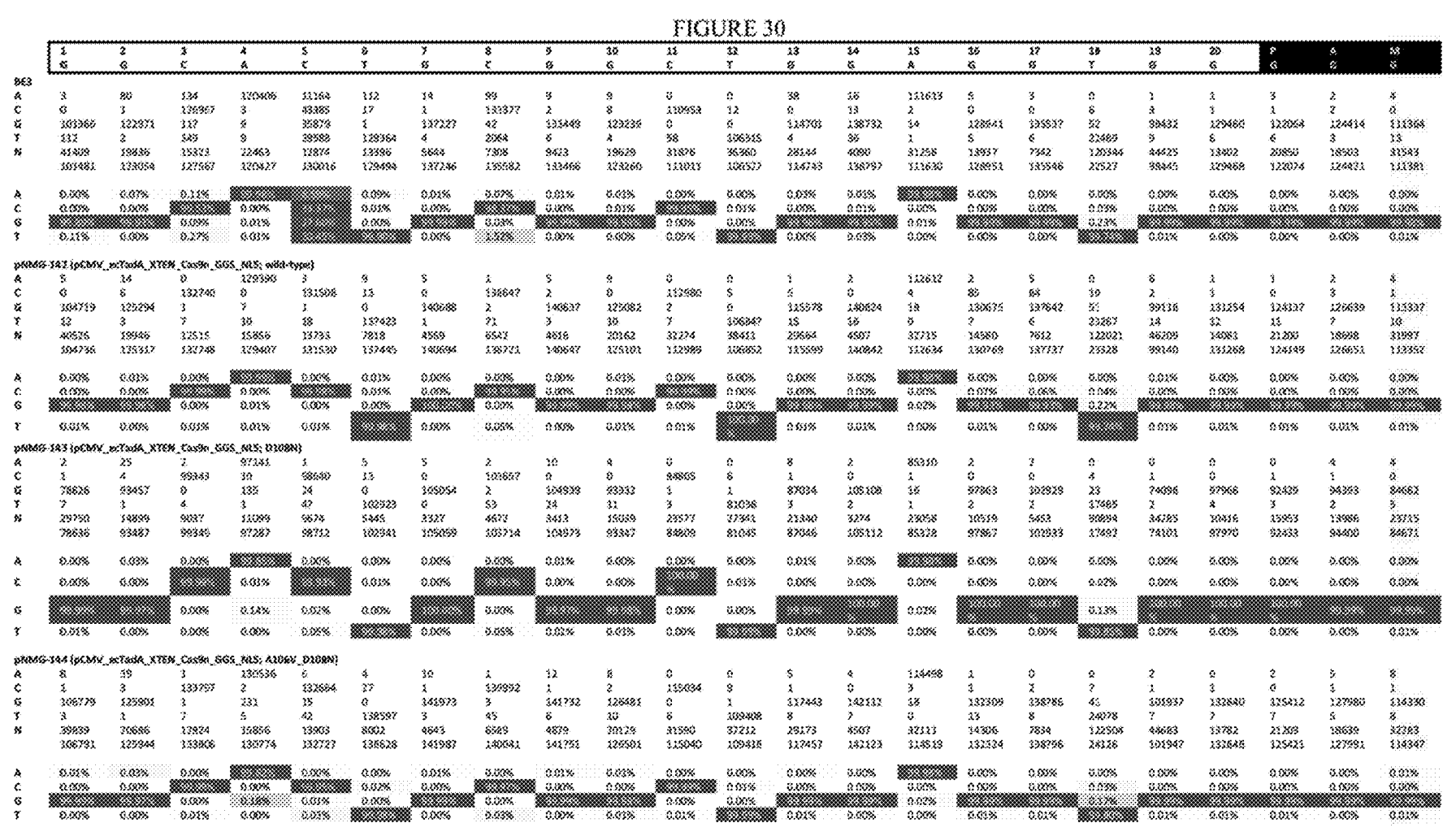
Figure 30:
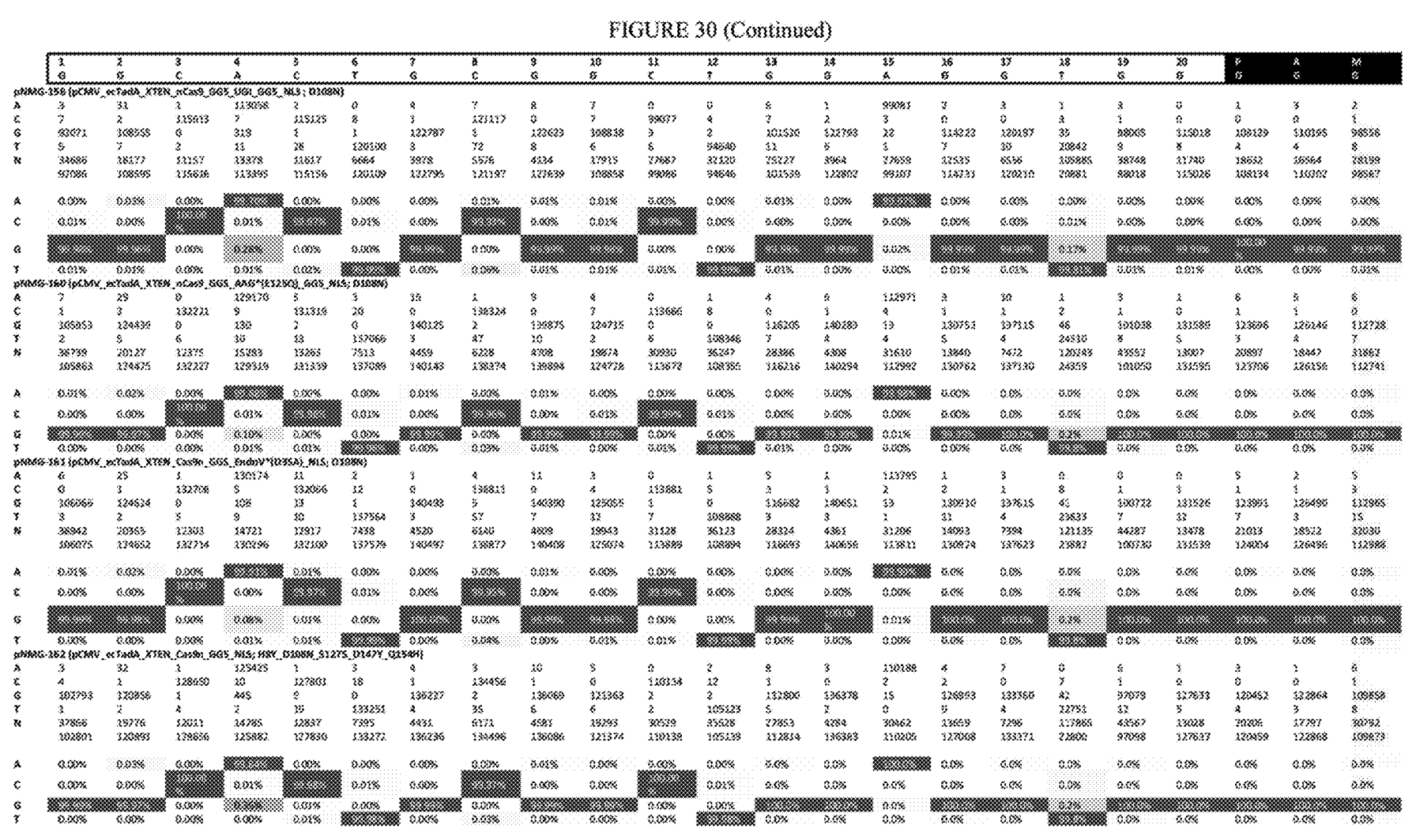
Figure 30:
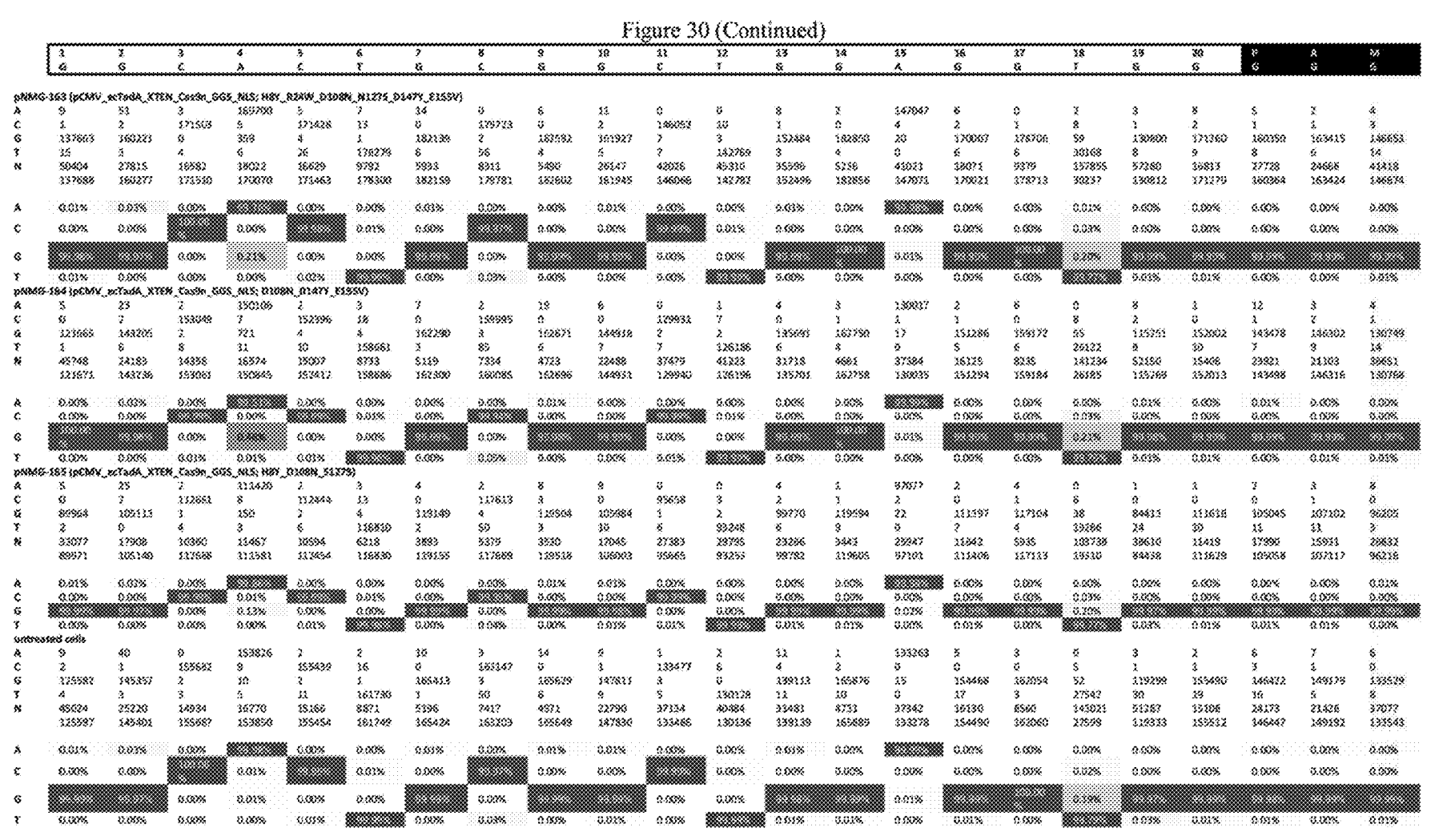

FIG. 30 shows the results of editing at the Hek-4 site. The sequence corresponds to SEQ ID NO: 43.

Figure 31:
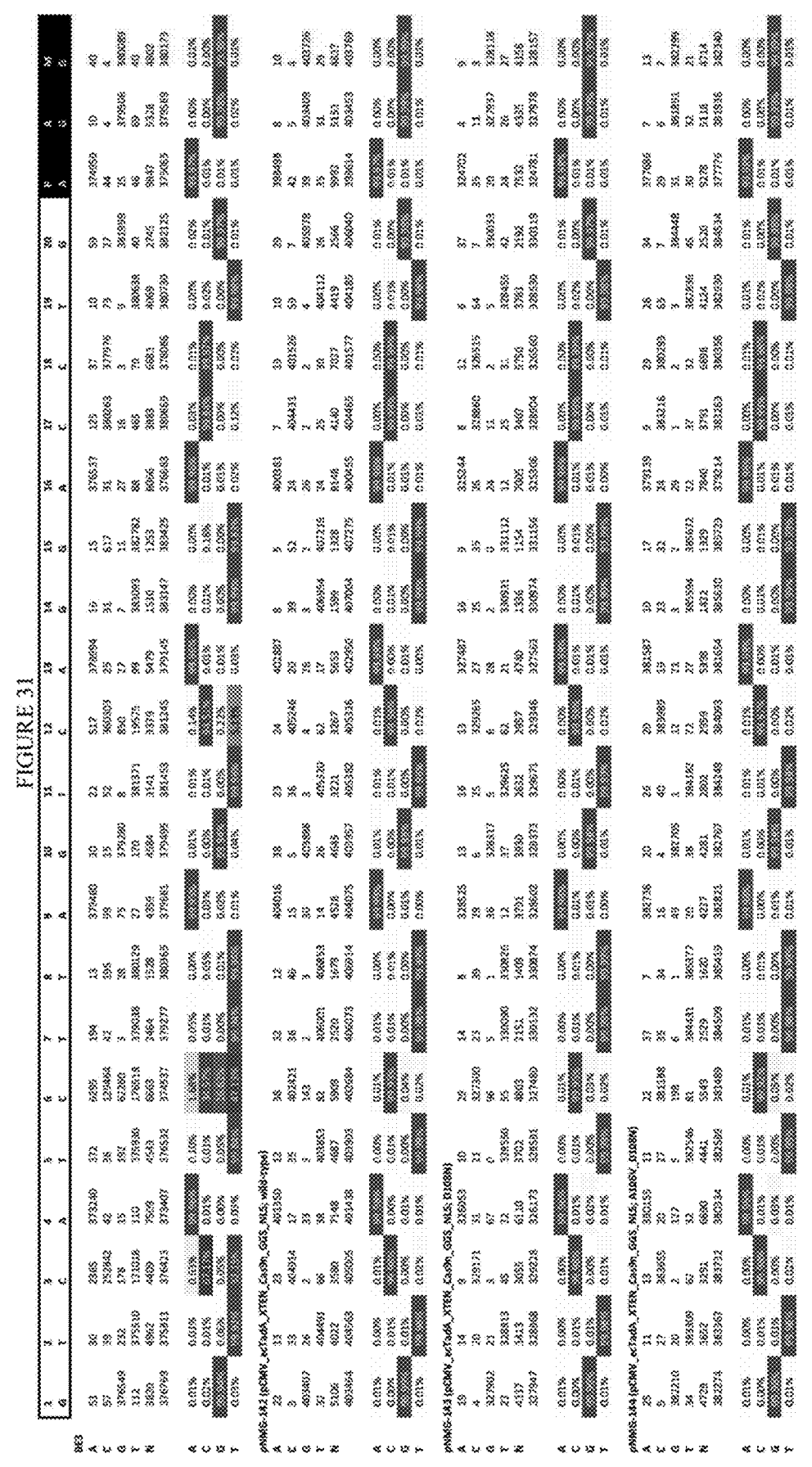
Figure 31:
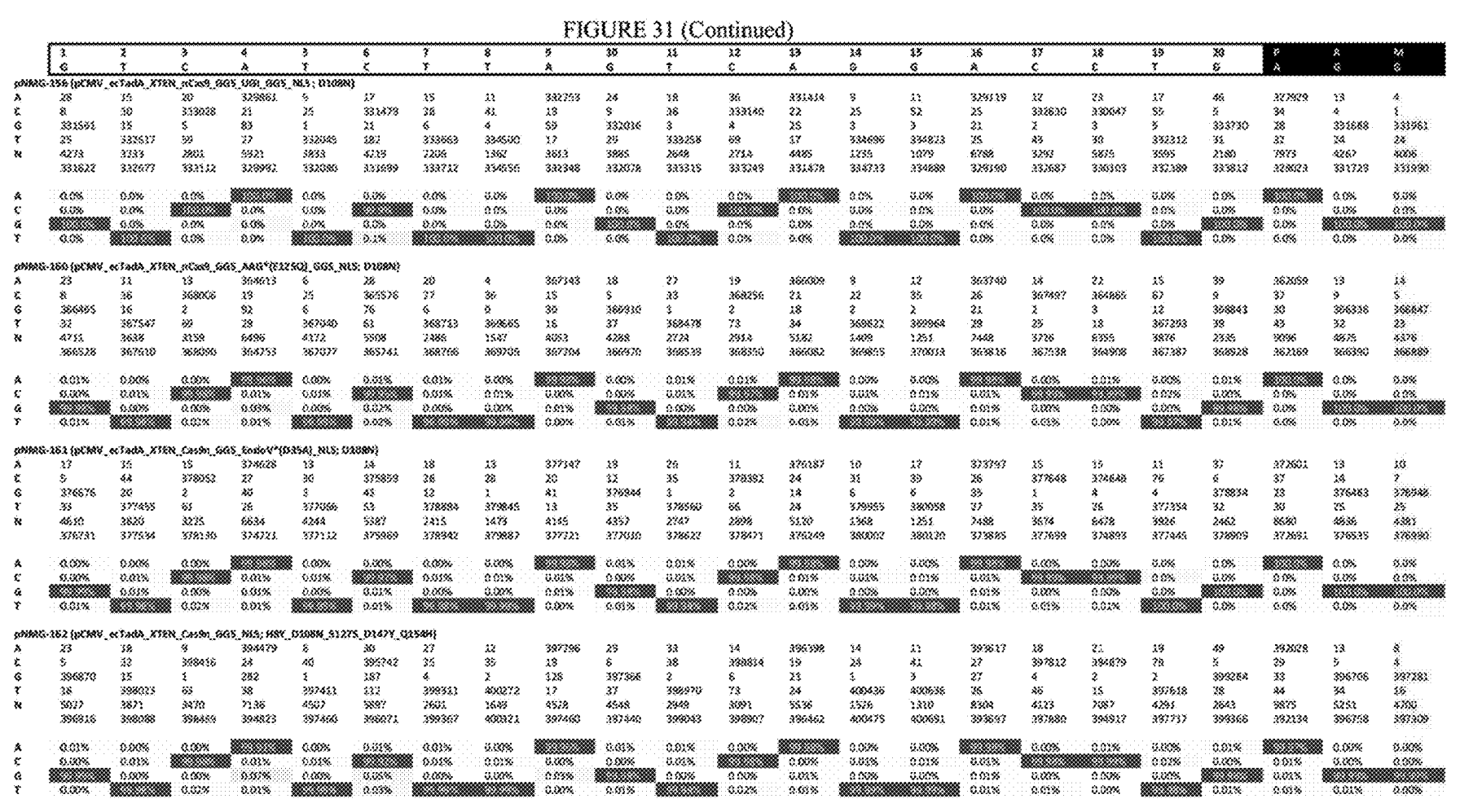
Figure 31:
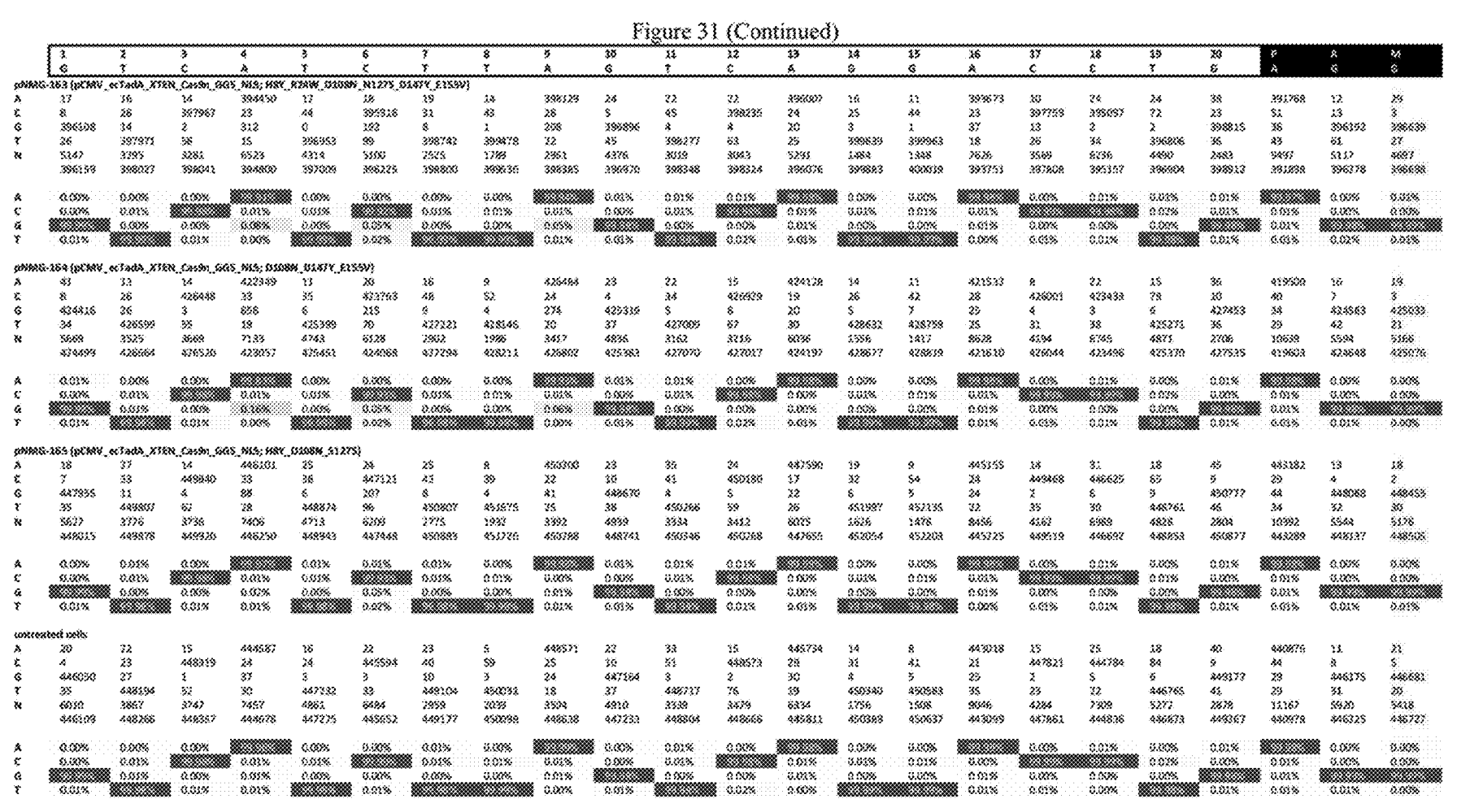

FIG. 31 shows the results of editing at the RNF-2 site. The sequence corresponds to SEQ ID NO: 44.

Figure 32:
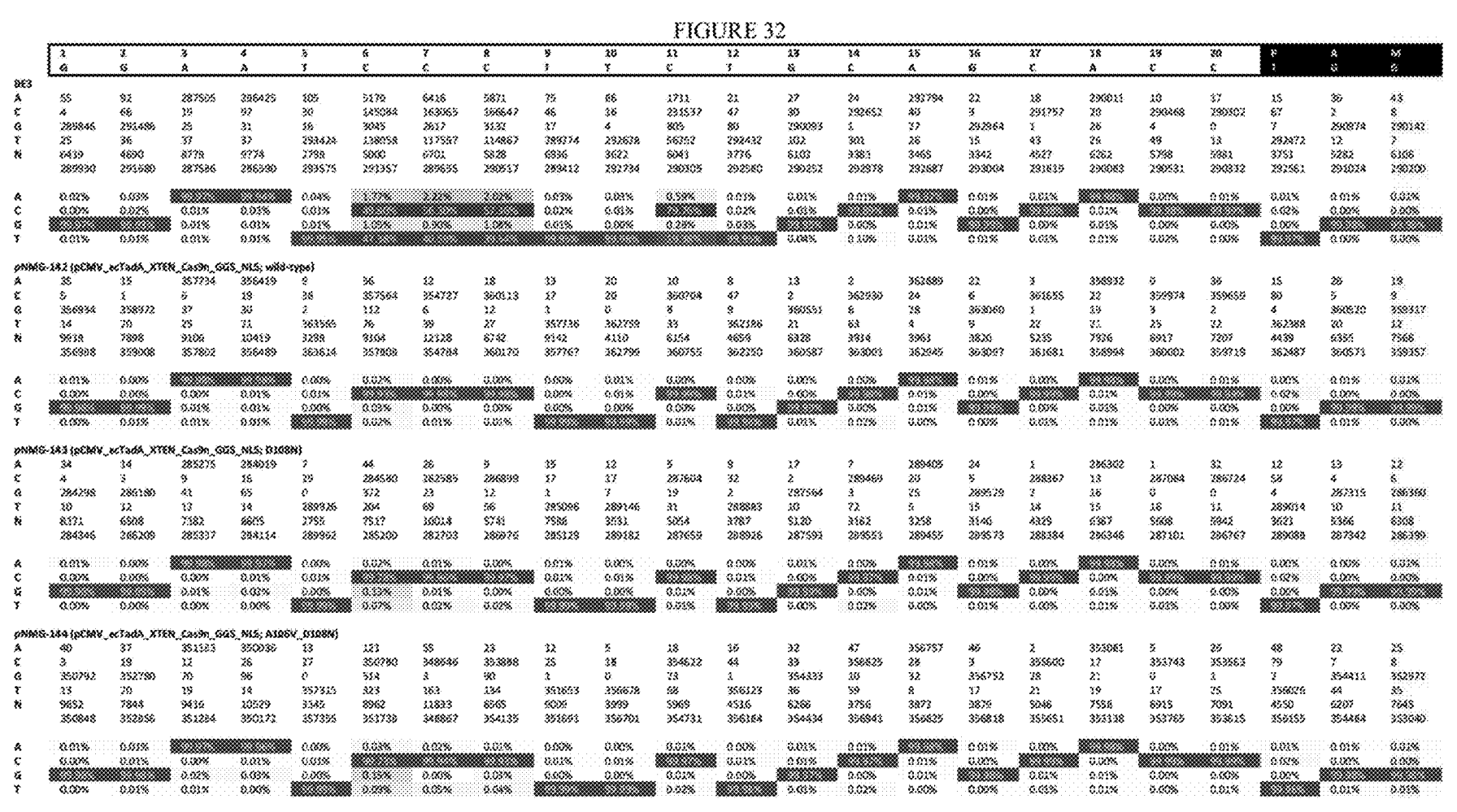
Figure 32:
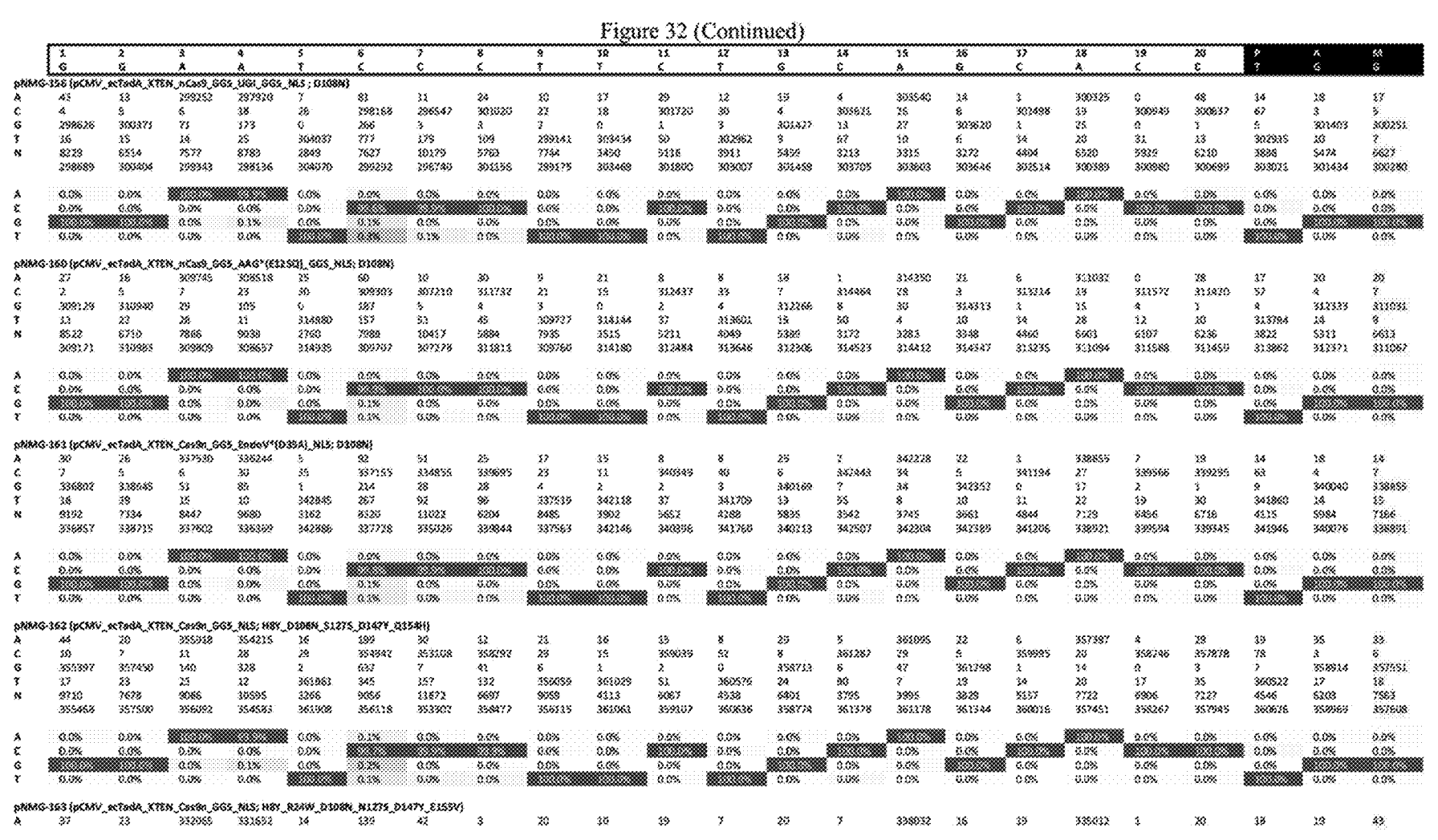
Figure 32:
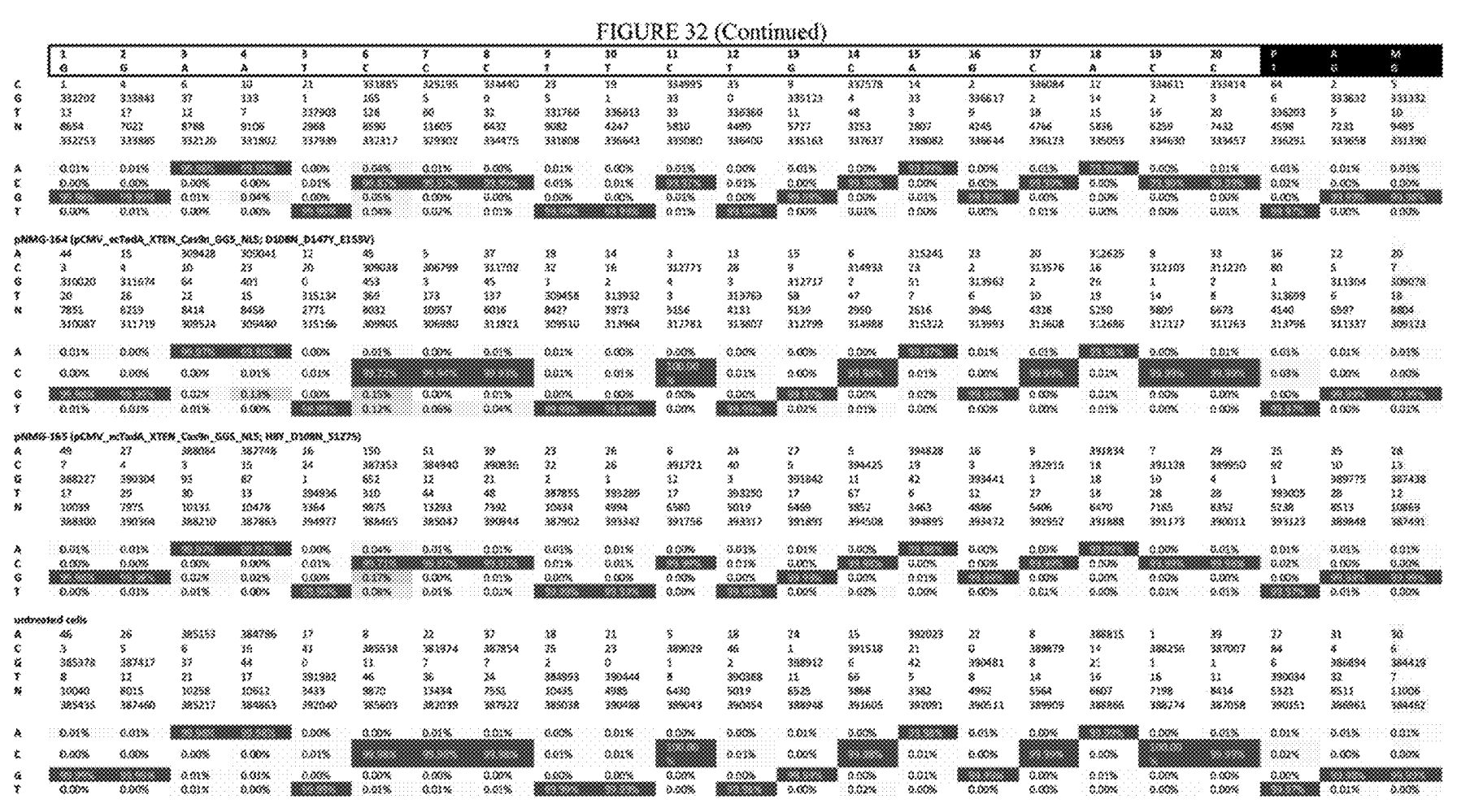

FIG. 32 shows the results of editing at the FANCF site. The sequence corresponds to SEQ ID NO: 45.

Figure 33:
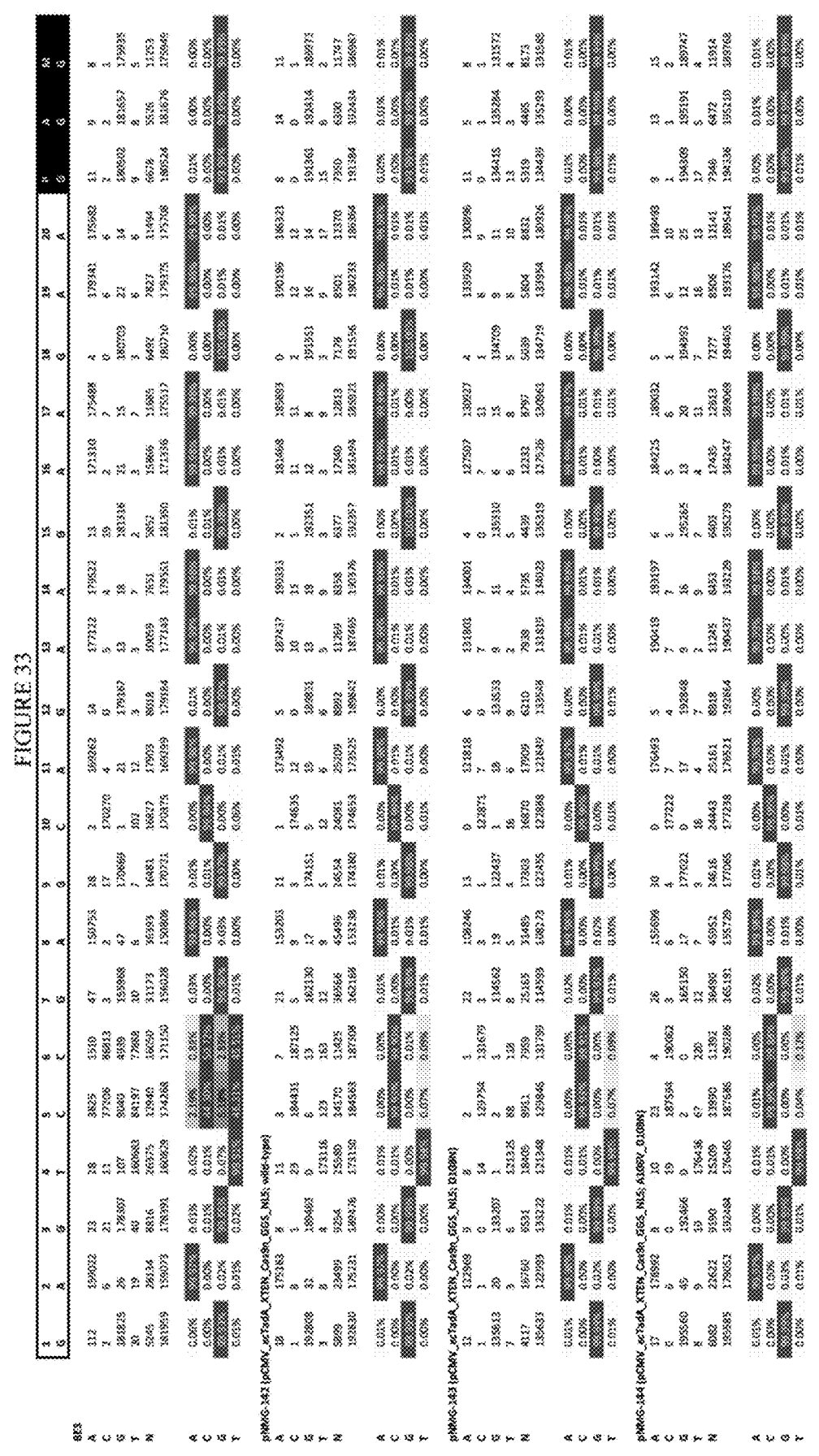
Figure 33:
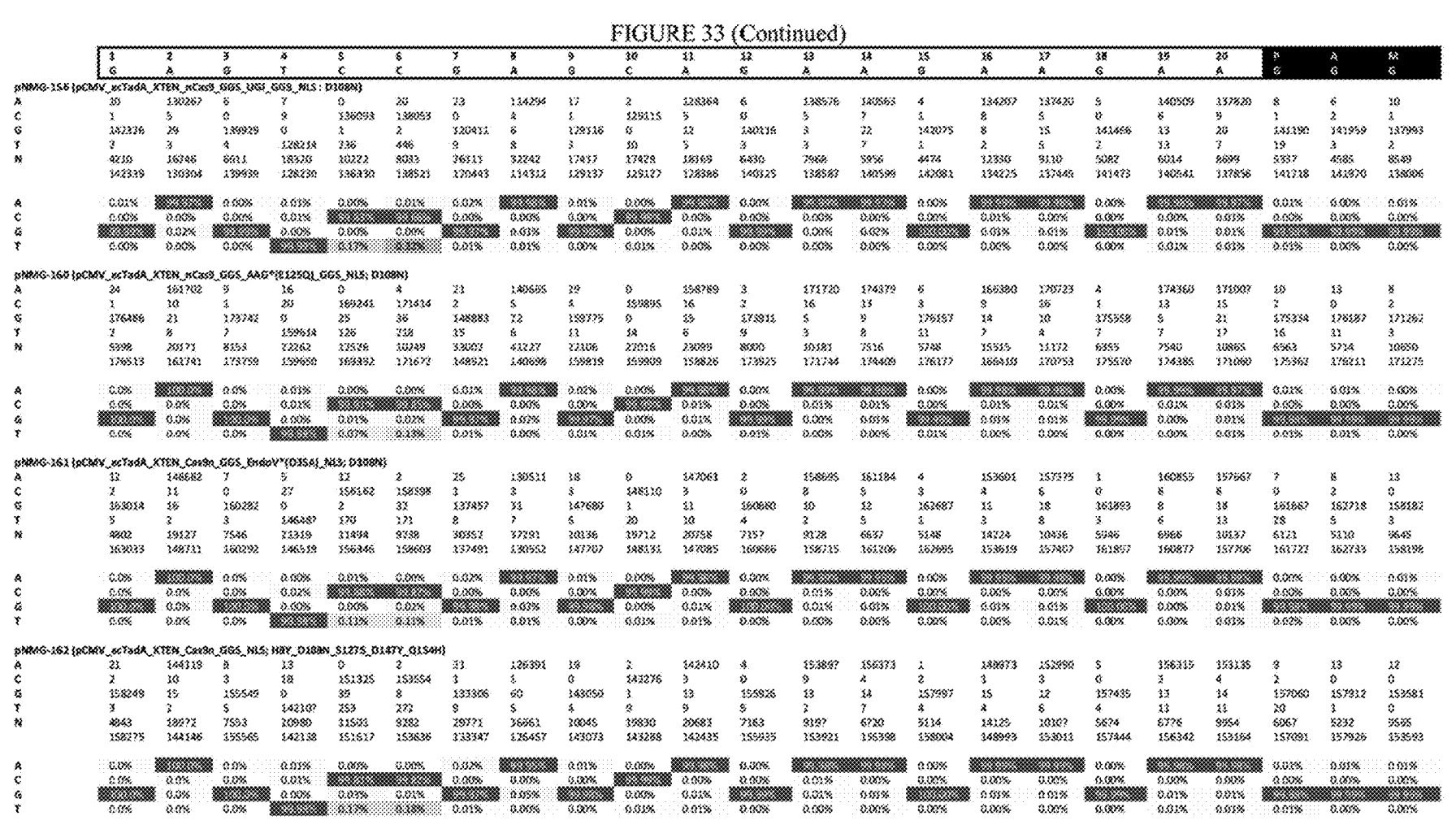
Figure 33:
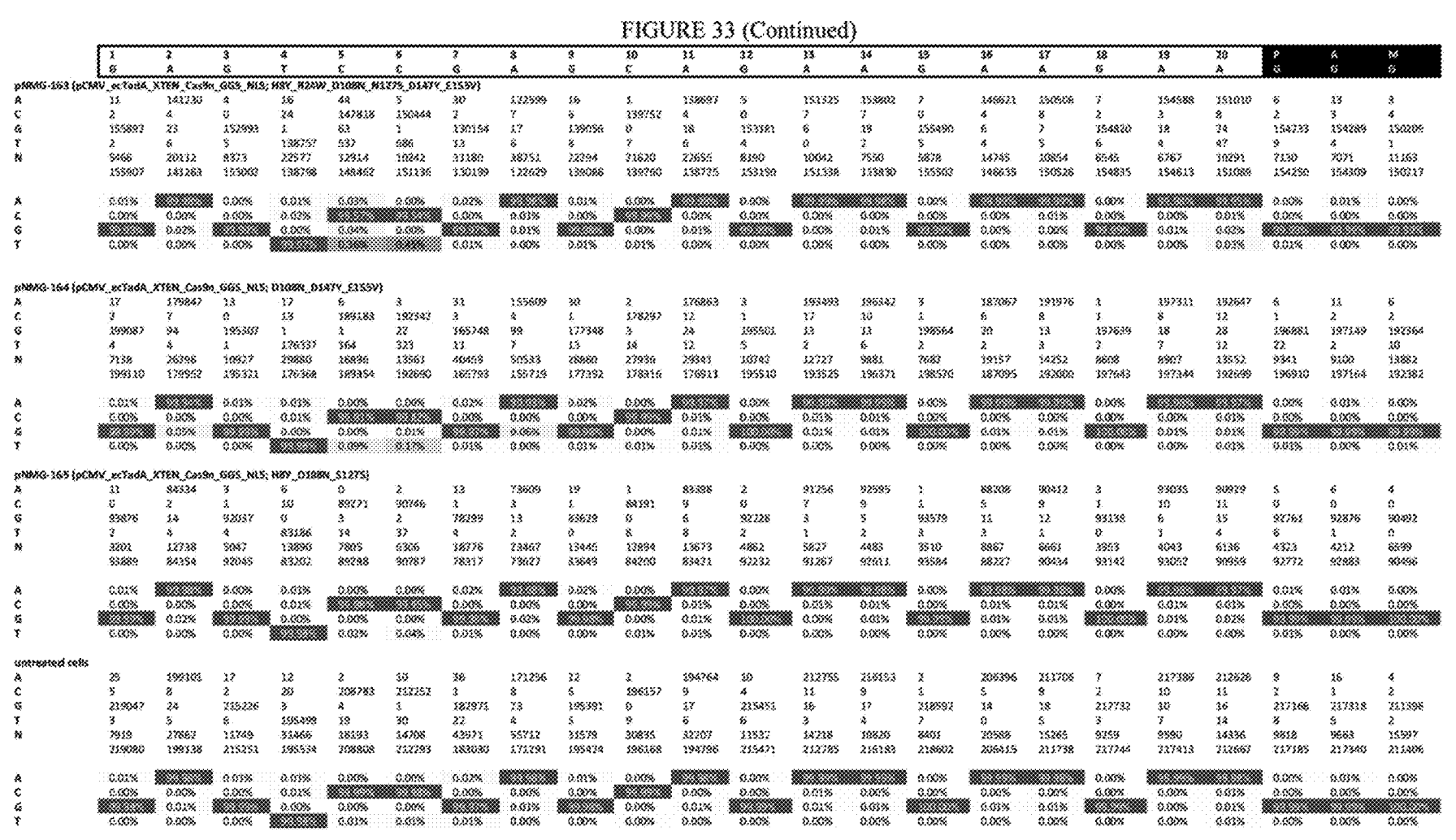

FIG. 33 shows the results of editing at the EMX-1 site. The sequence corresponds to SEQ ID NO: 46.

Figure 34:
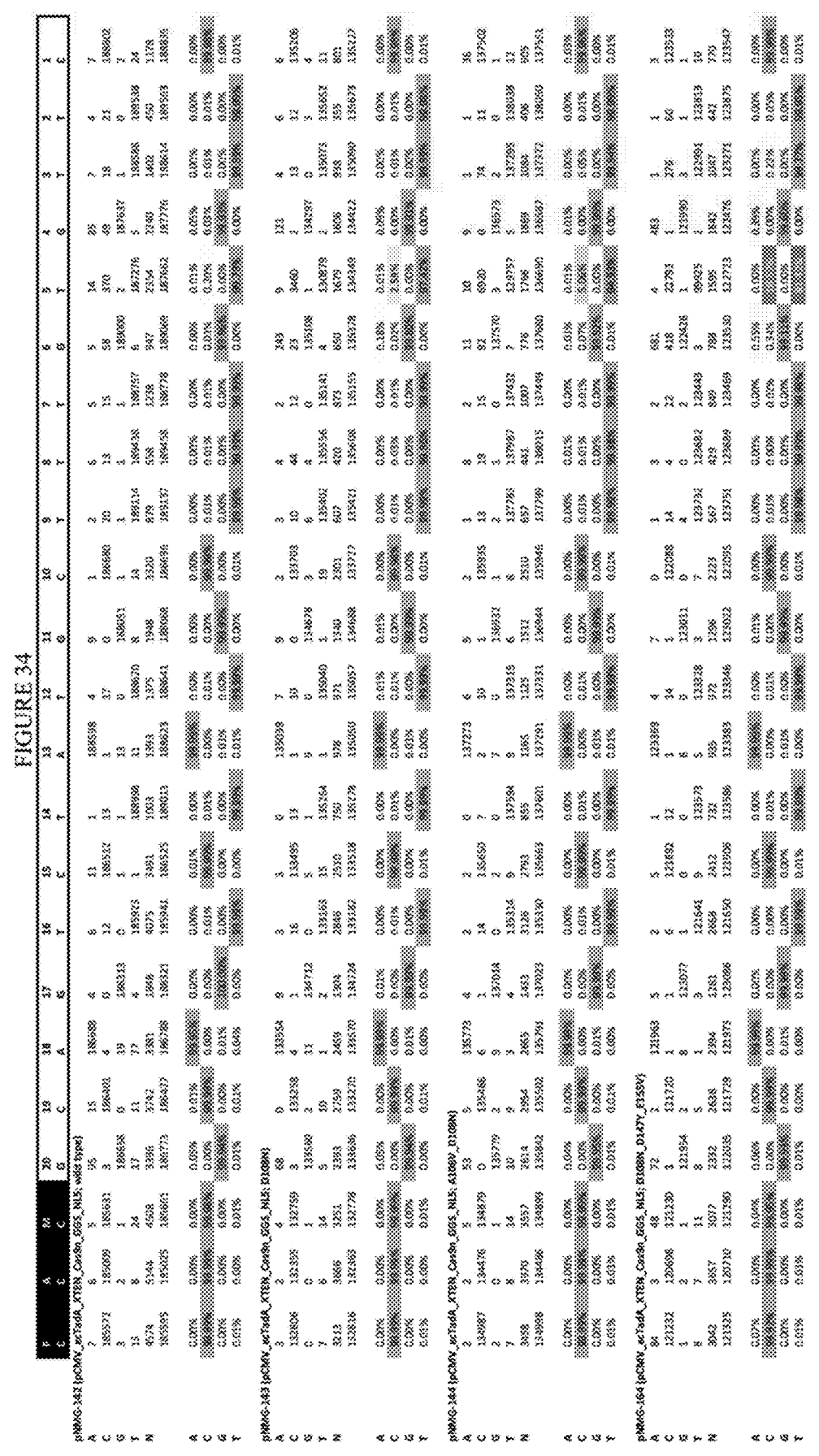
Figure 34:
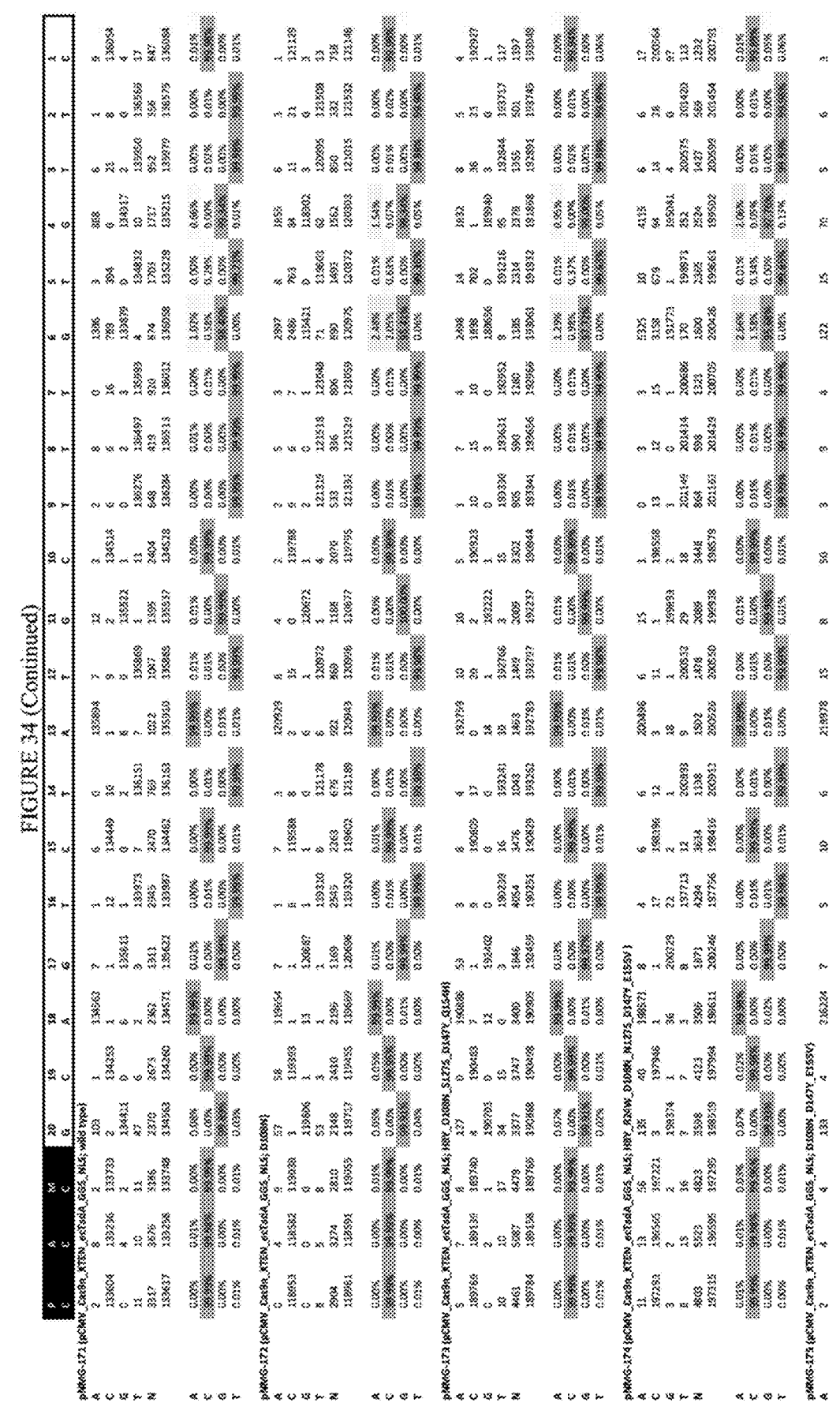
Figure 34:
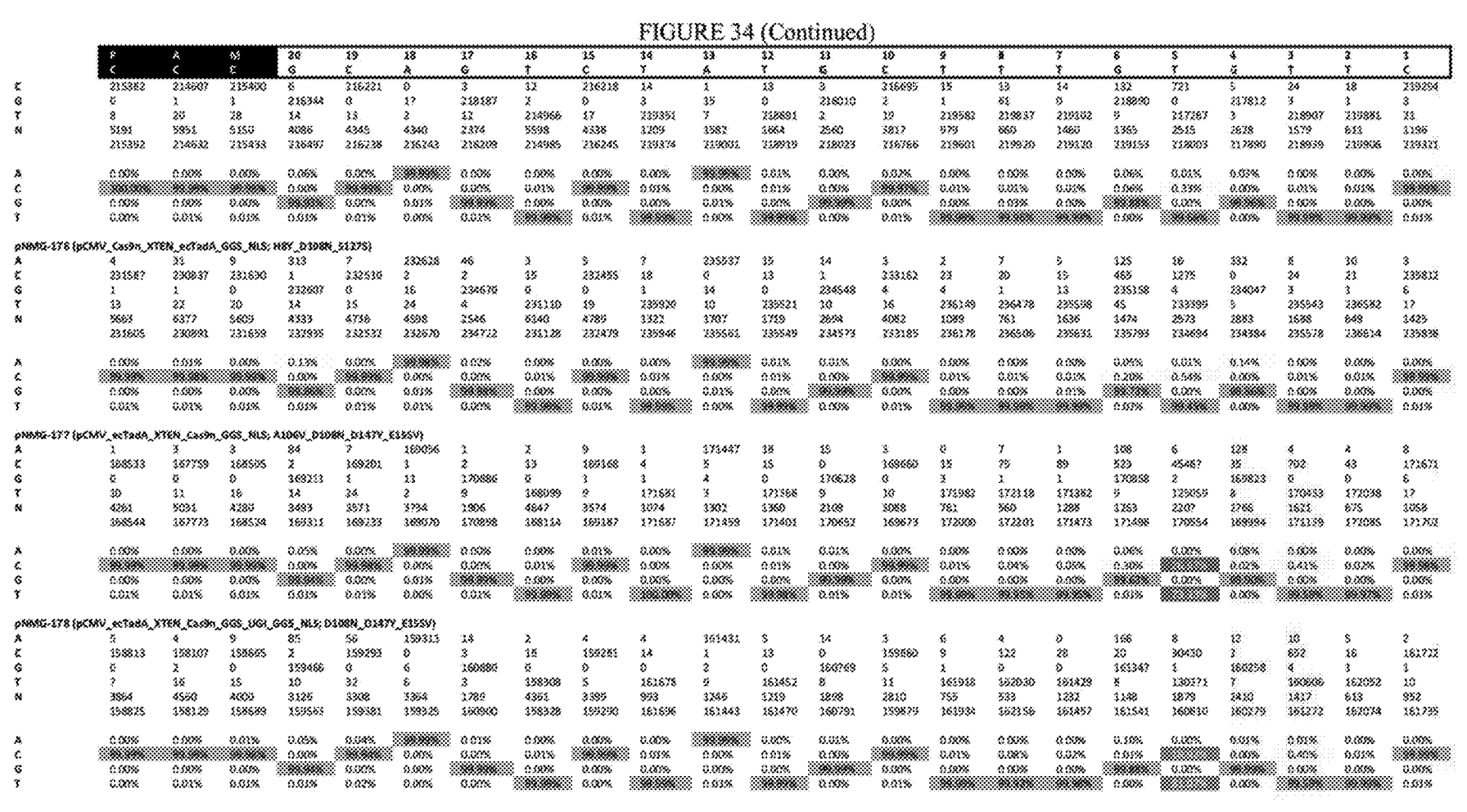
Figure 34:
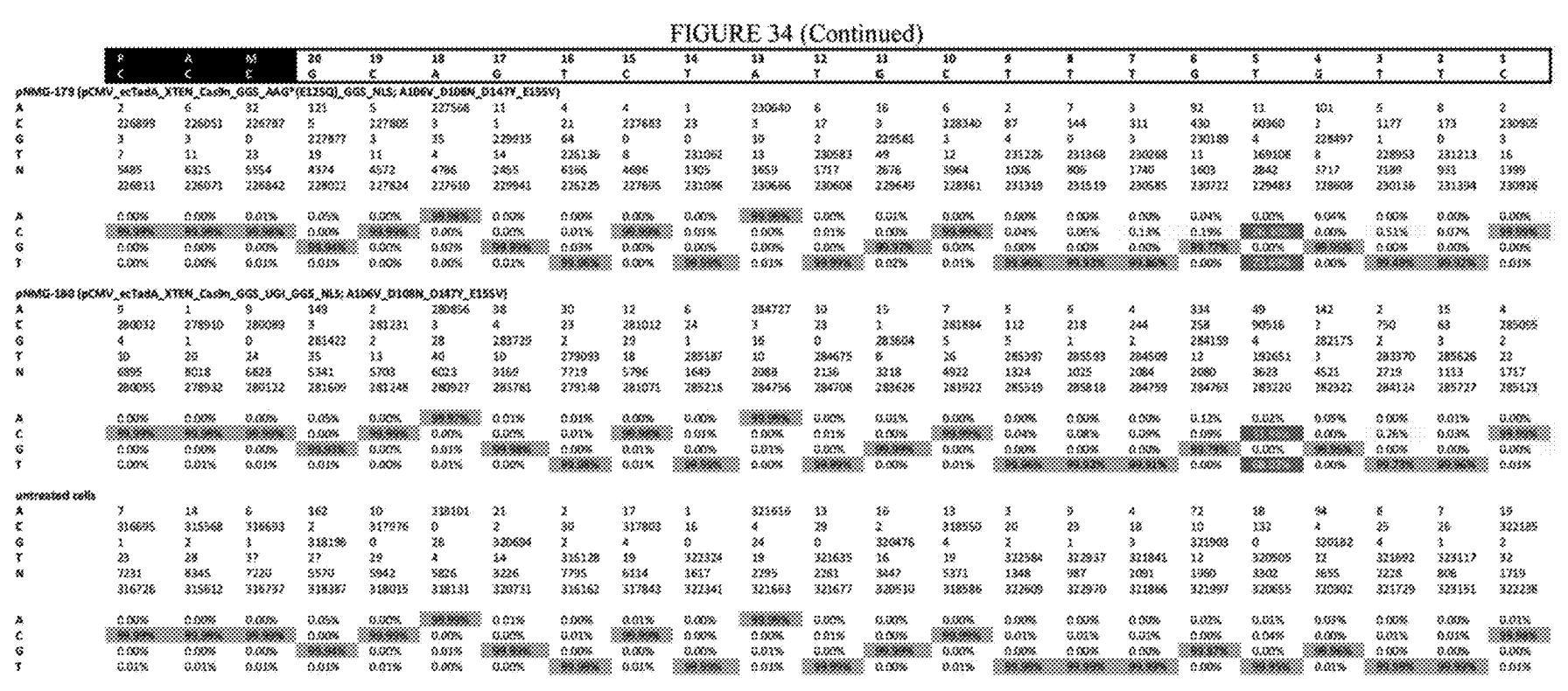

FIG. 34 shows the results of C-terminal fusion at the Hek-2 site. The sequence corresponds to SEQ ID NO: 41.

Figure 35:
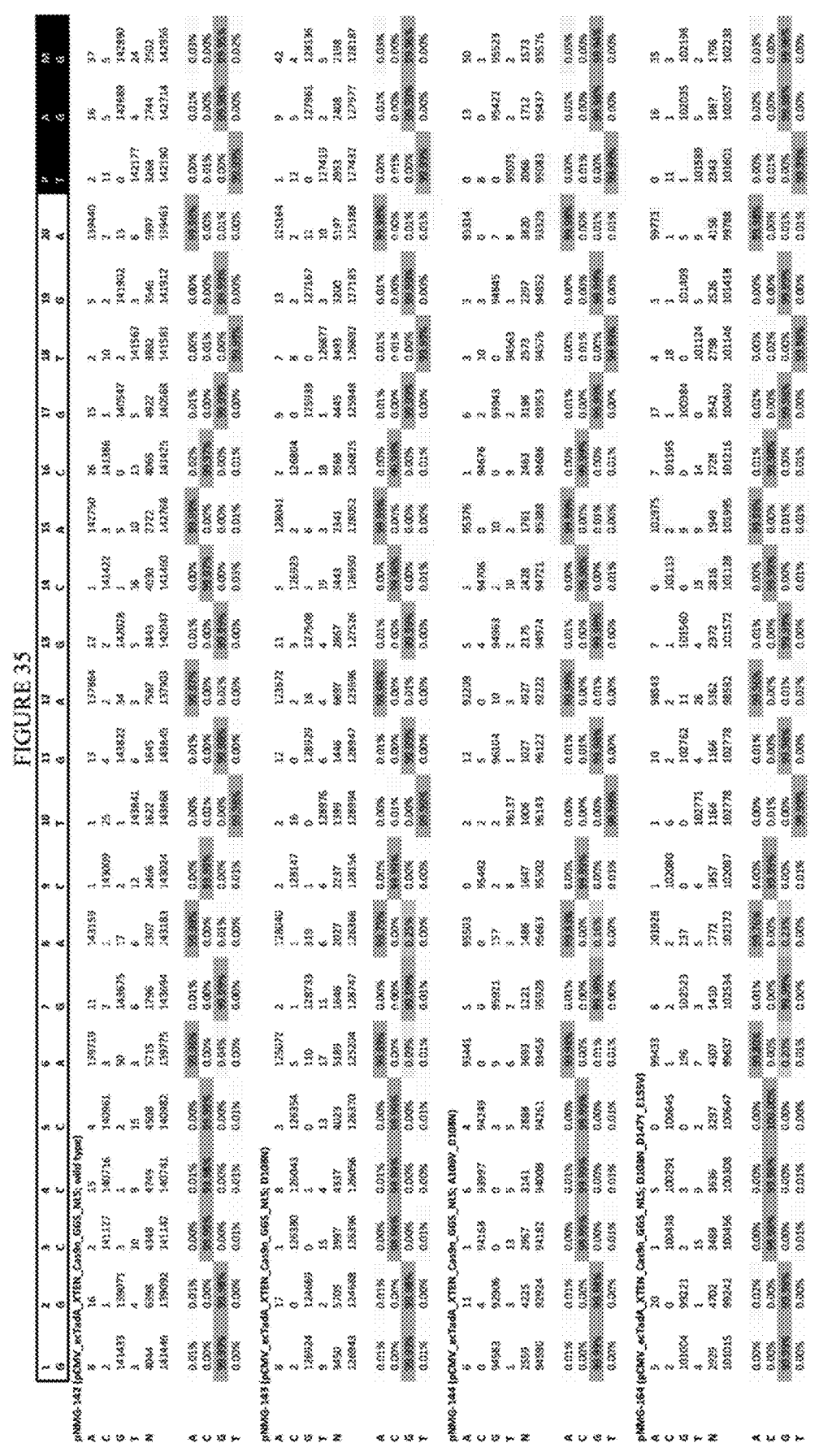
Figure 35:
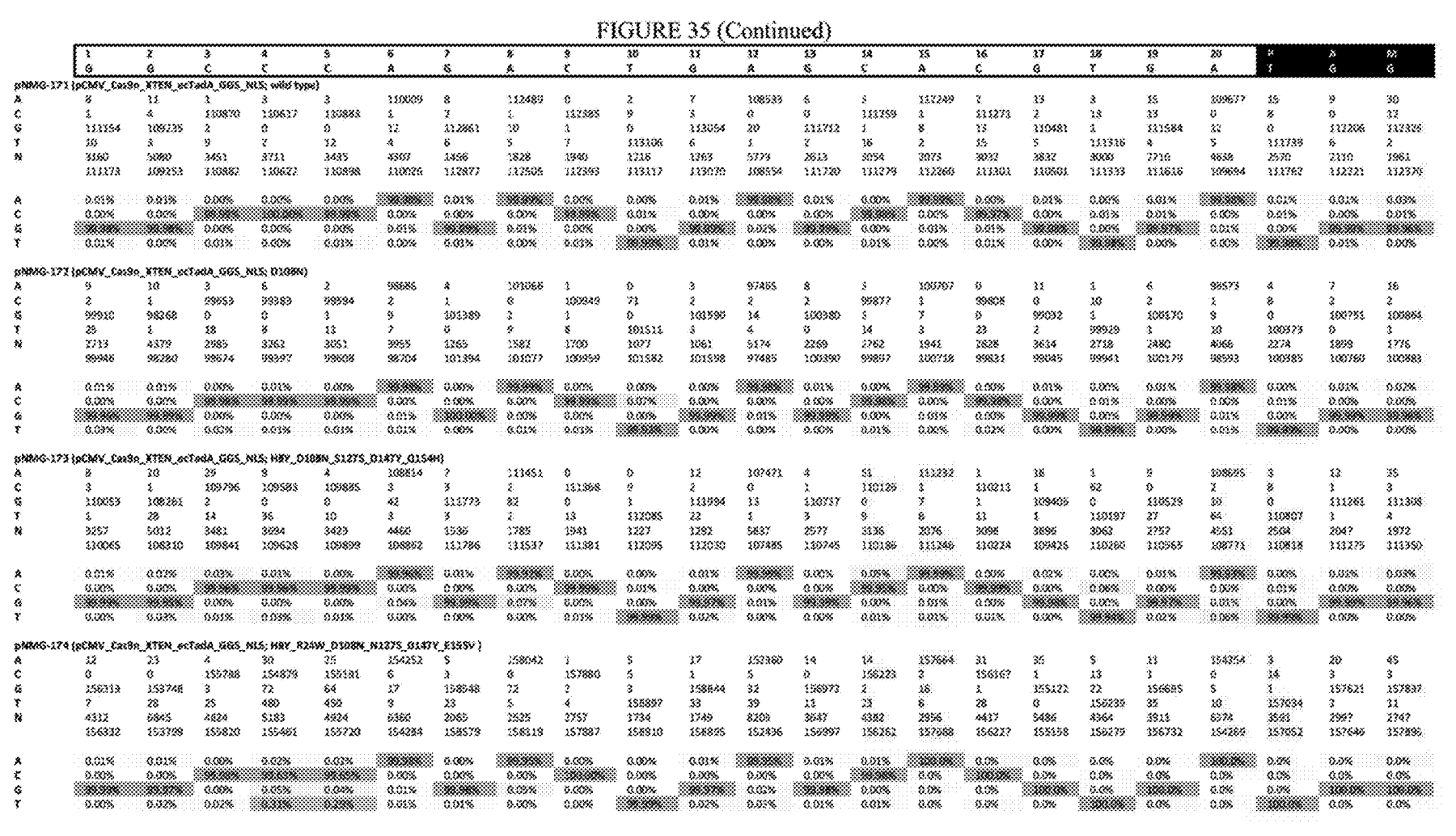
Figure 35:
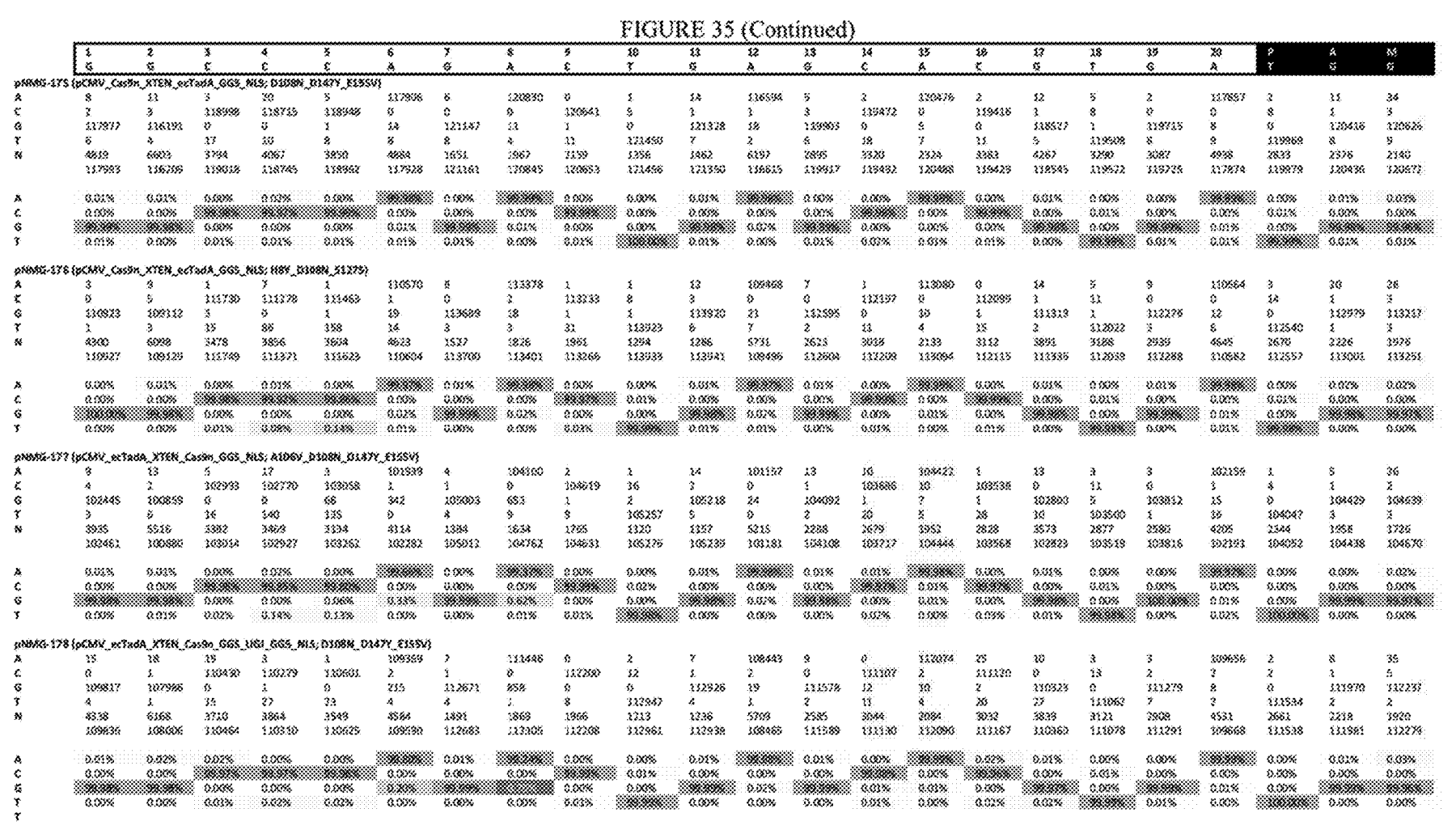
Figure 35:
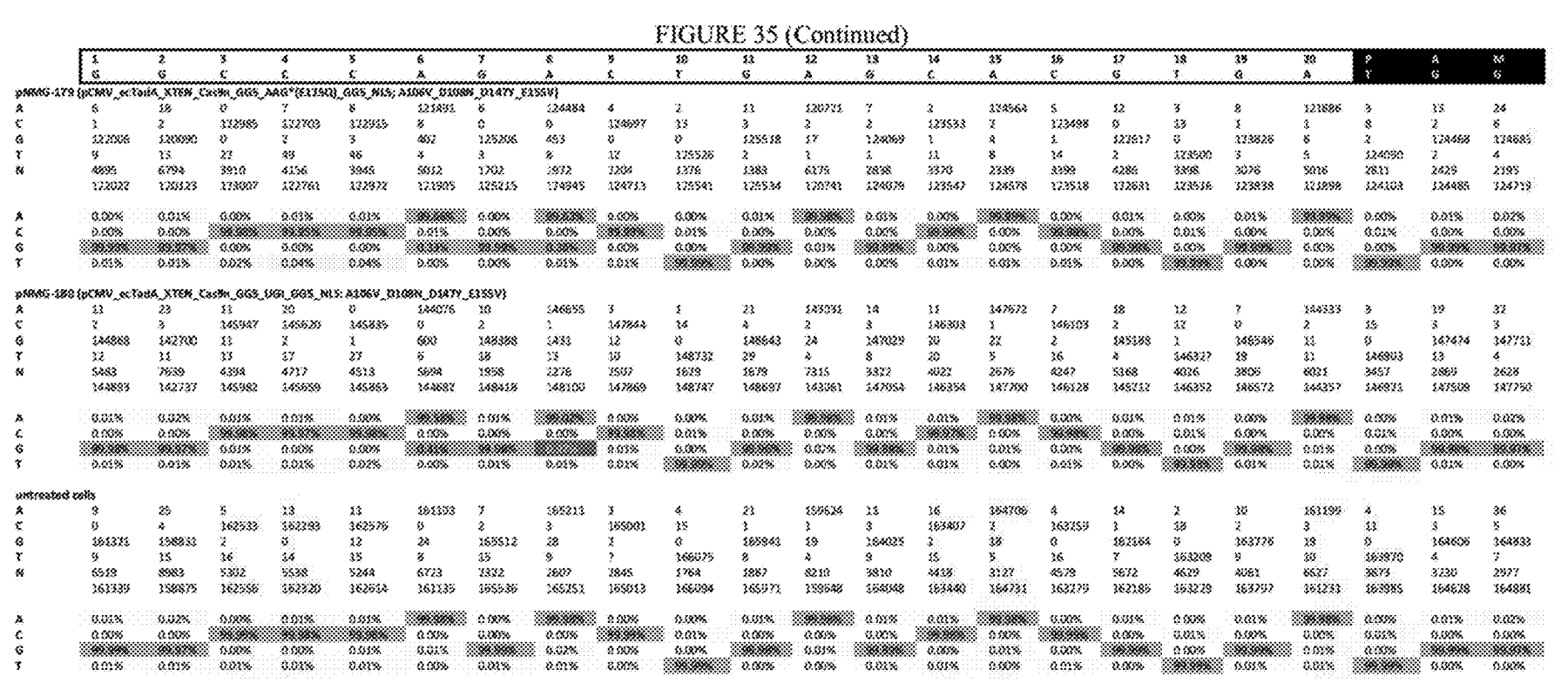

FIG. 35 shows the results of C-terminal fusion at the Hek-3 site. The sequence corresponds to SEQ ID NO: 42.

Figure 36:
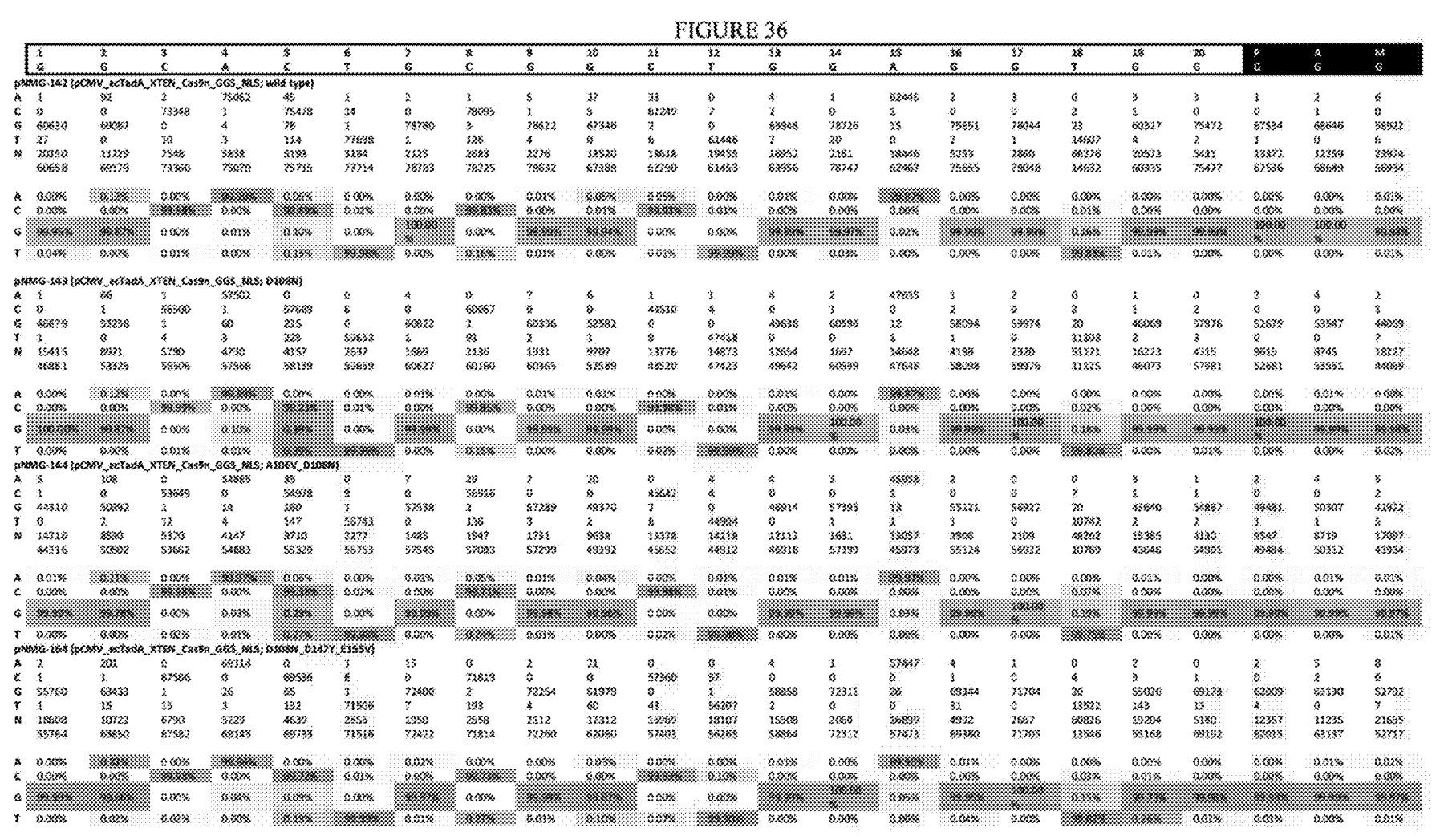
Figure 36:
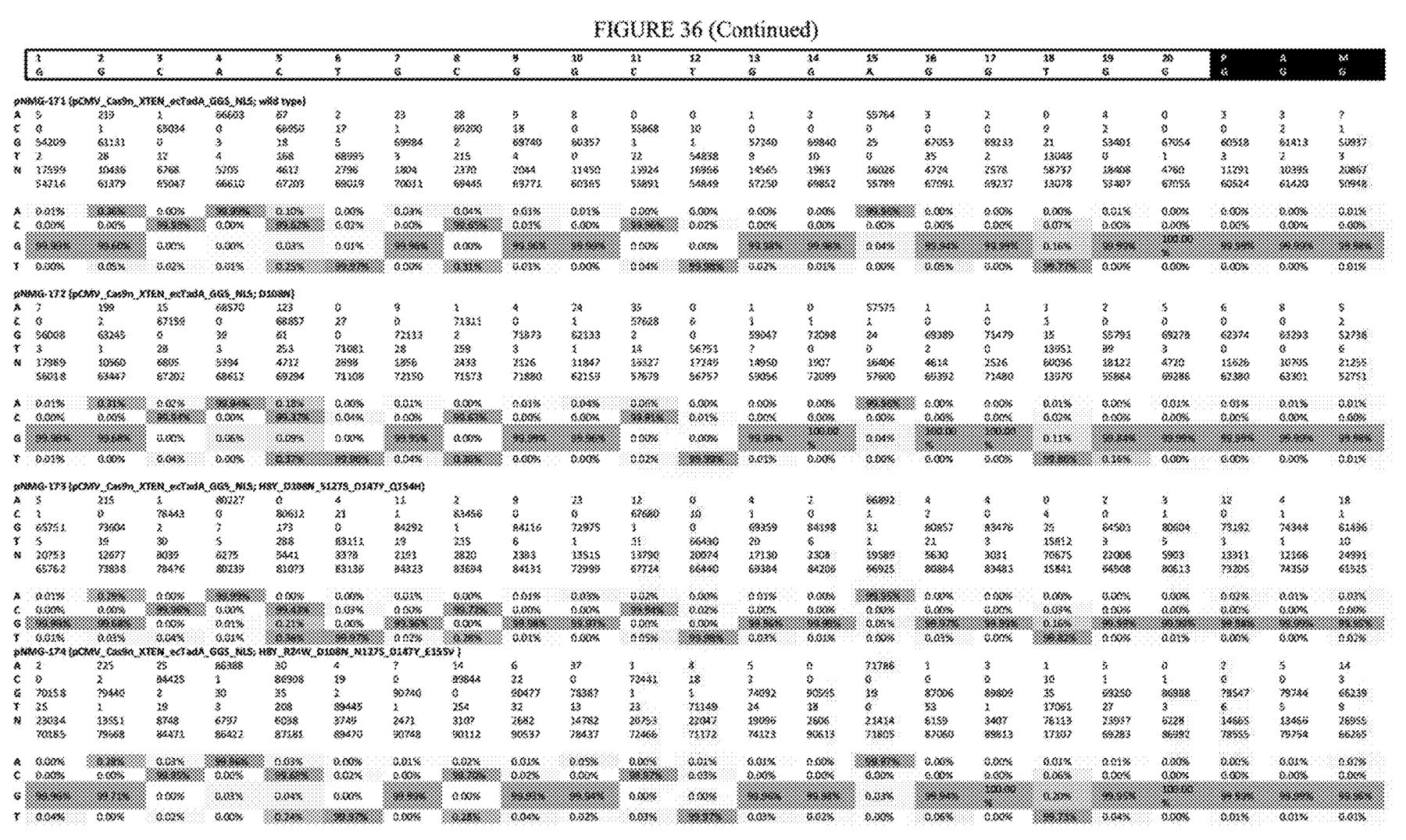
Figure 36:
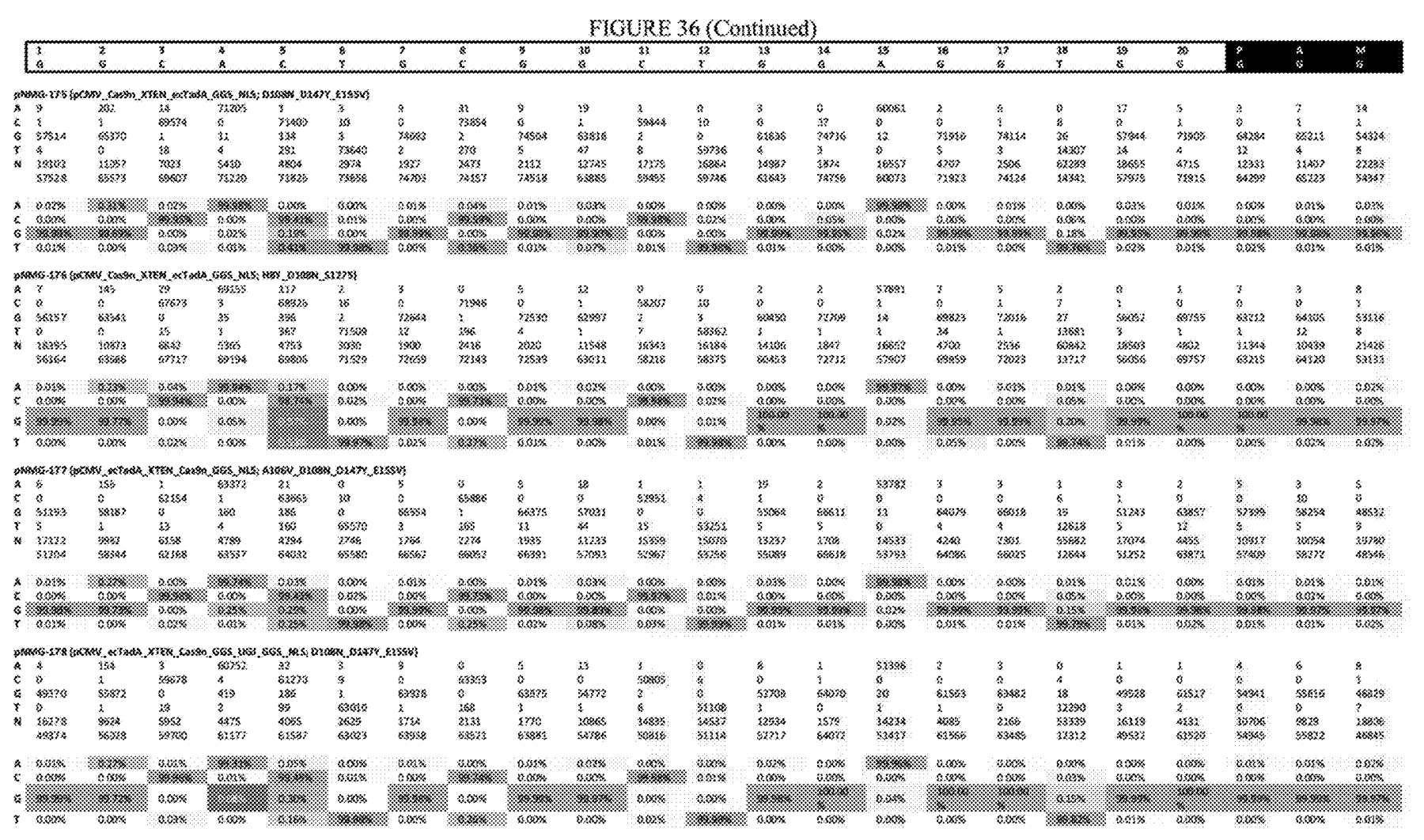
Figure 36:
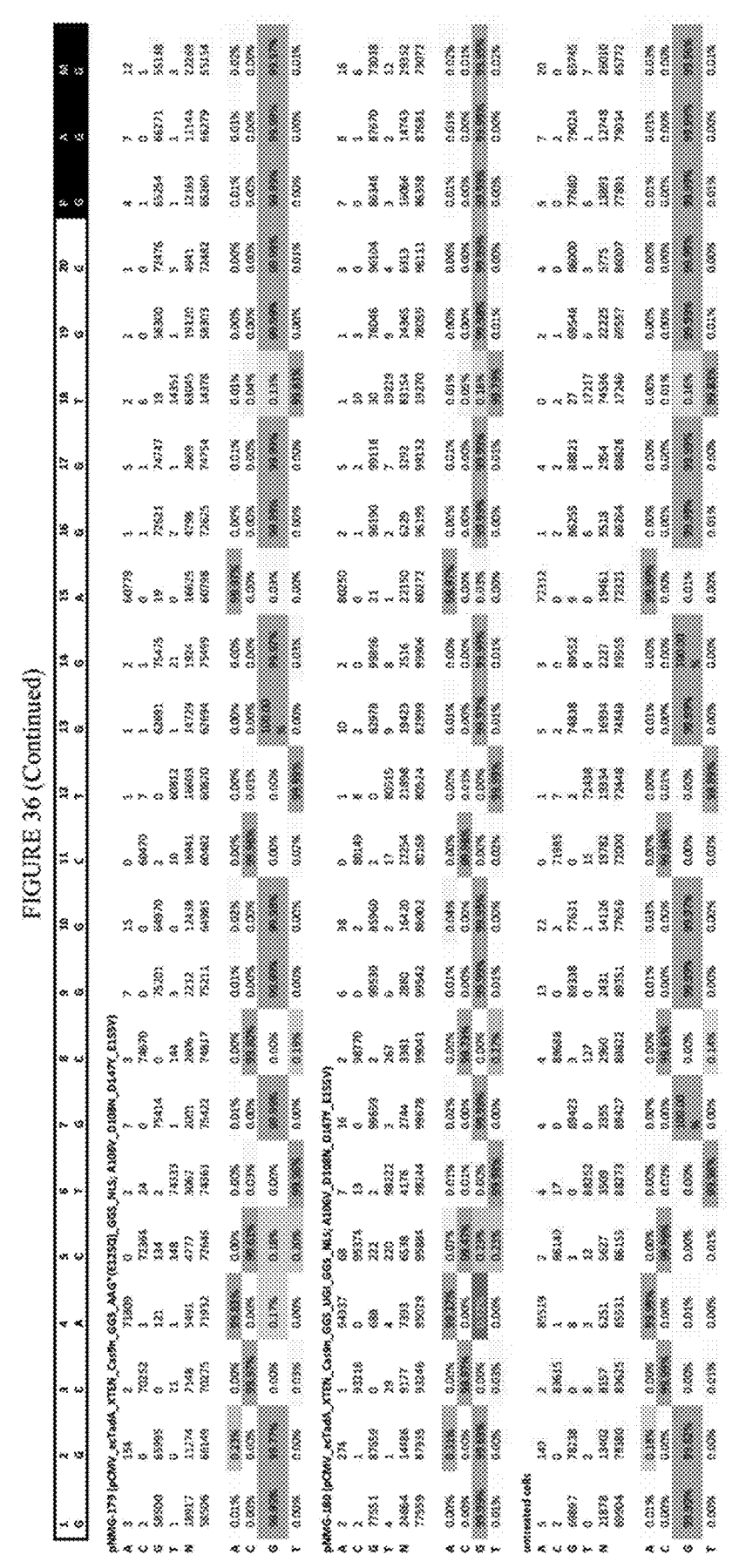

FIG. 36 shows the results of C-terminal fusion at the Hek-4 site. The sequence corresponds to SEQ ID NO: 43.

Figure 37:
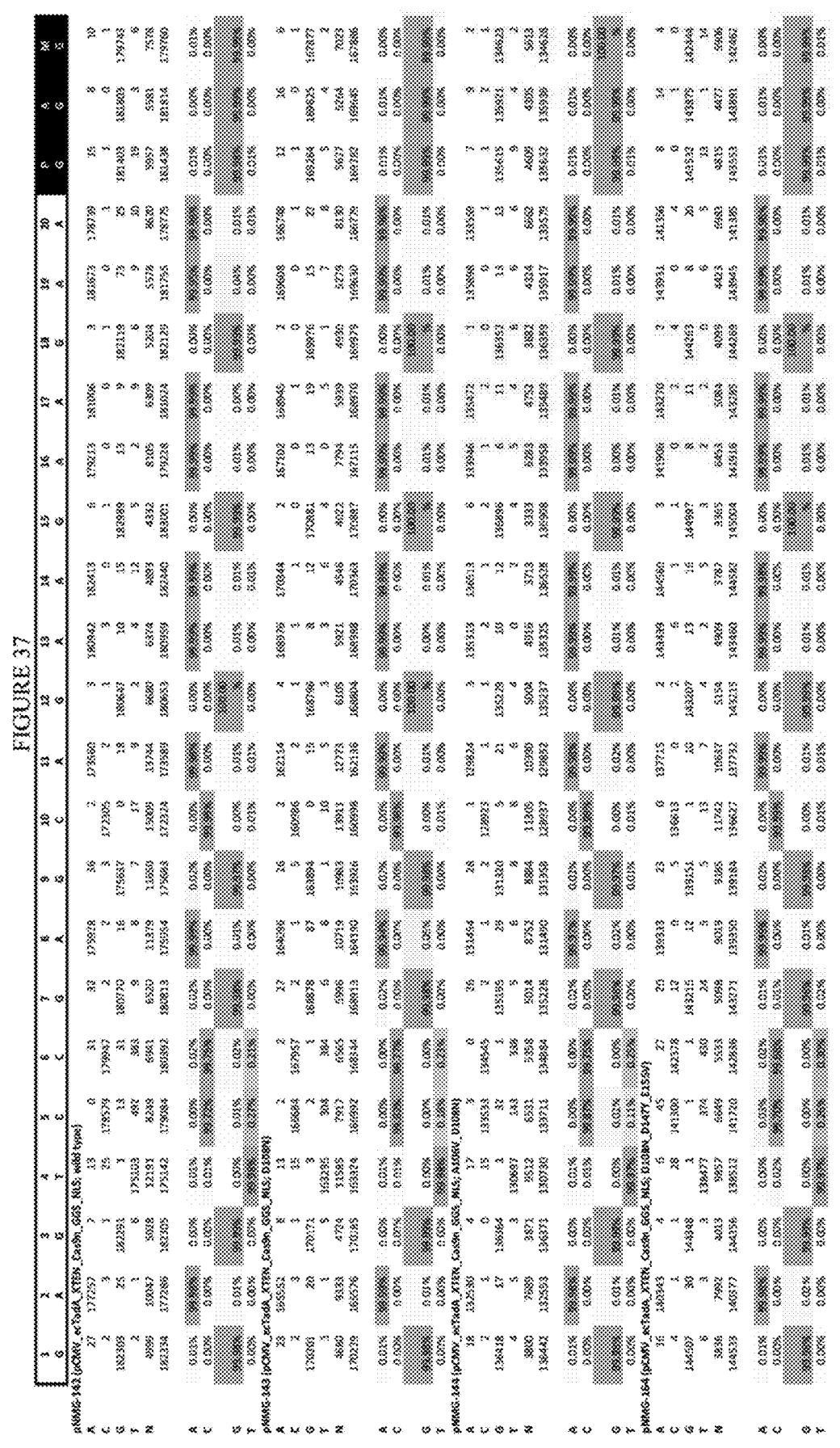
Figure 37:
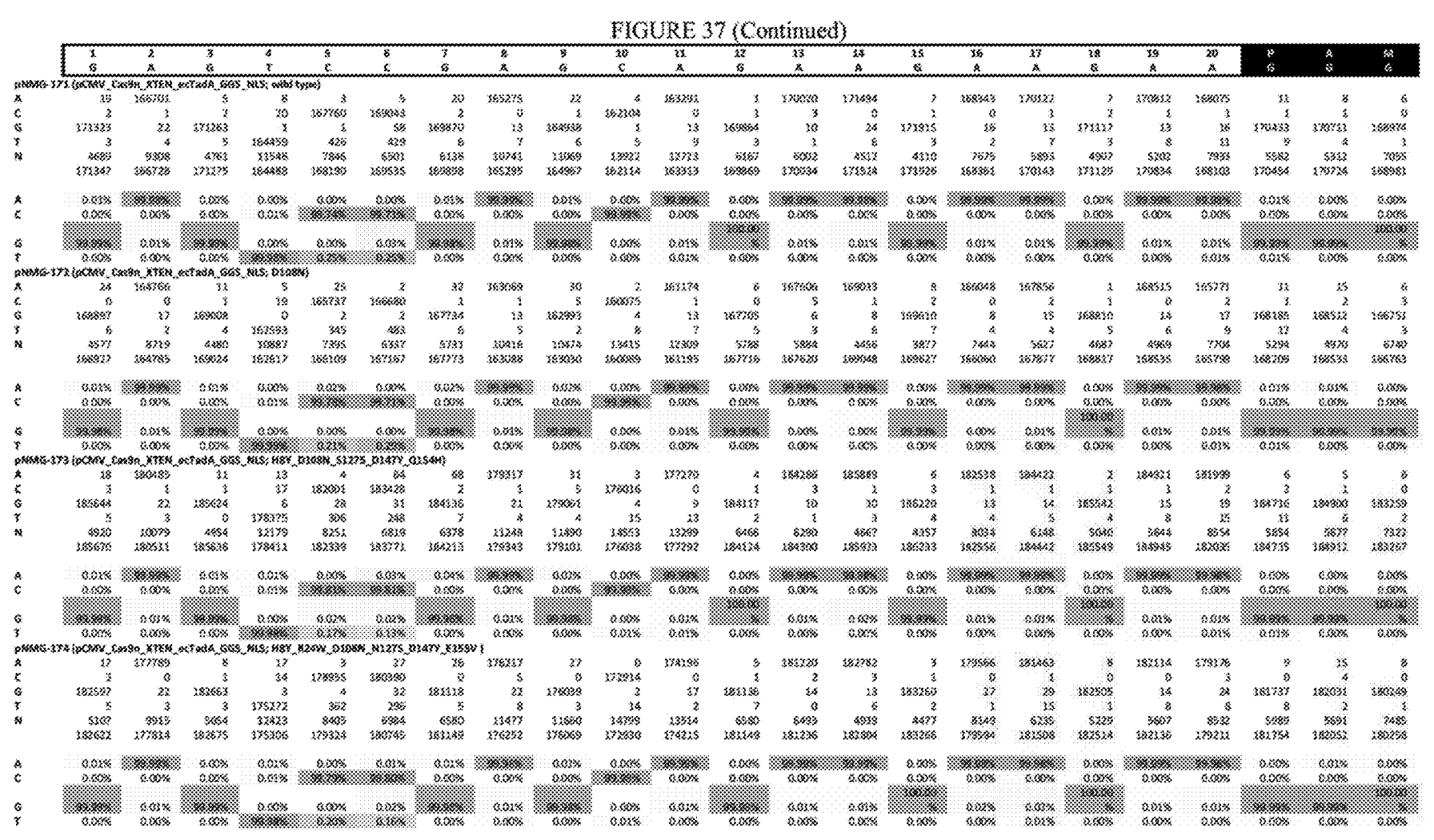
Figure 37:
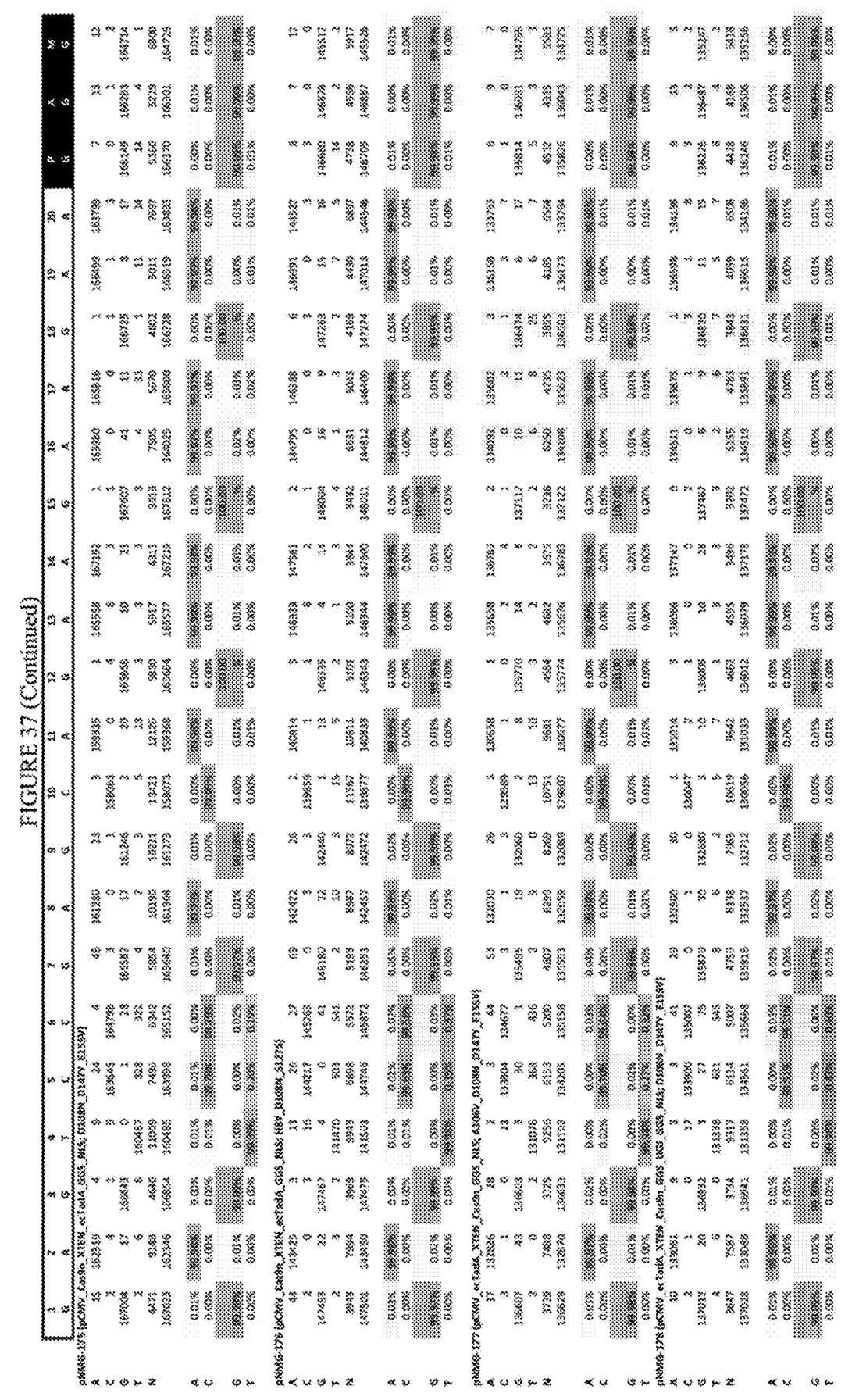
Figure 37:
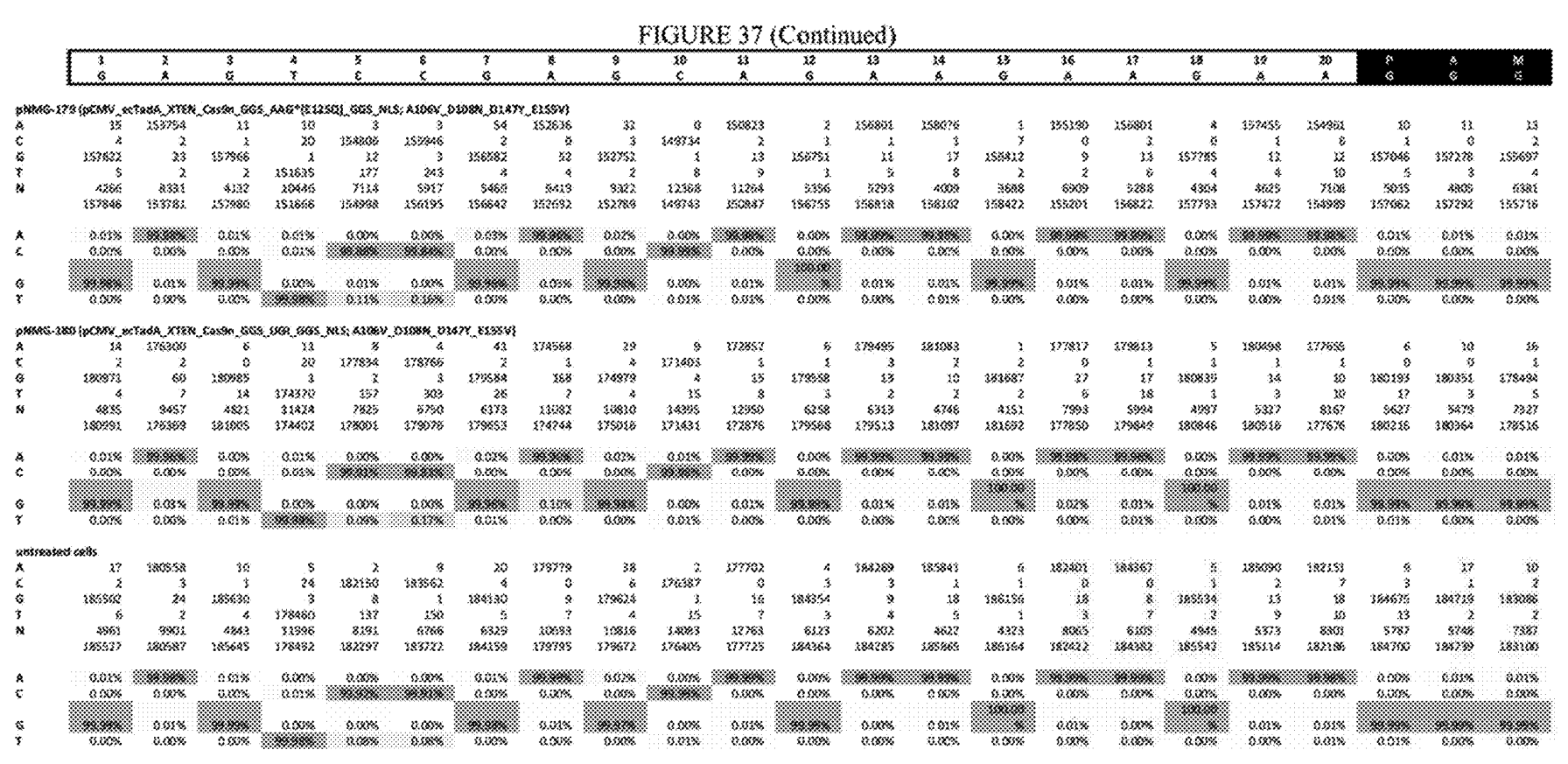

FIG. 37 shows the results of C-terminal fusion at the EMX-1 site. The sequence corresponds to SEQ ID NO: 46.

Figure 38:
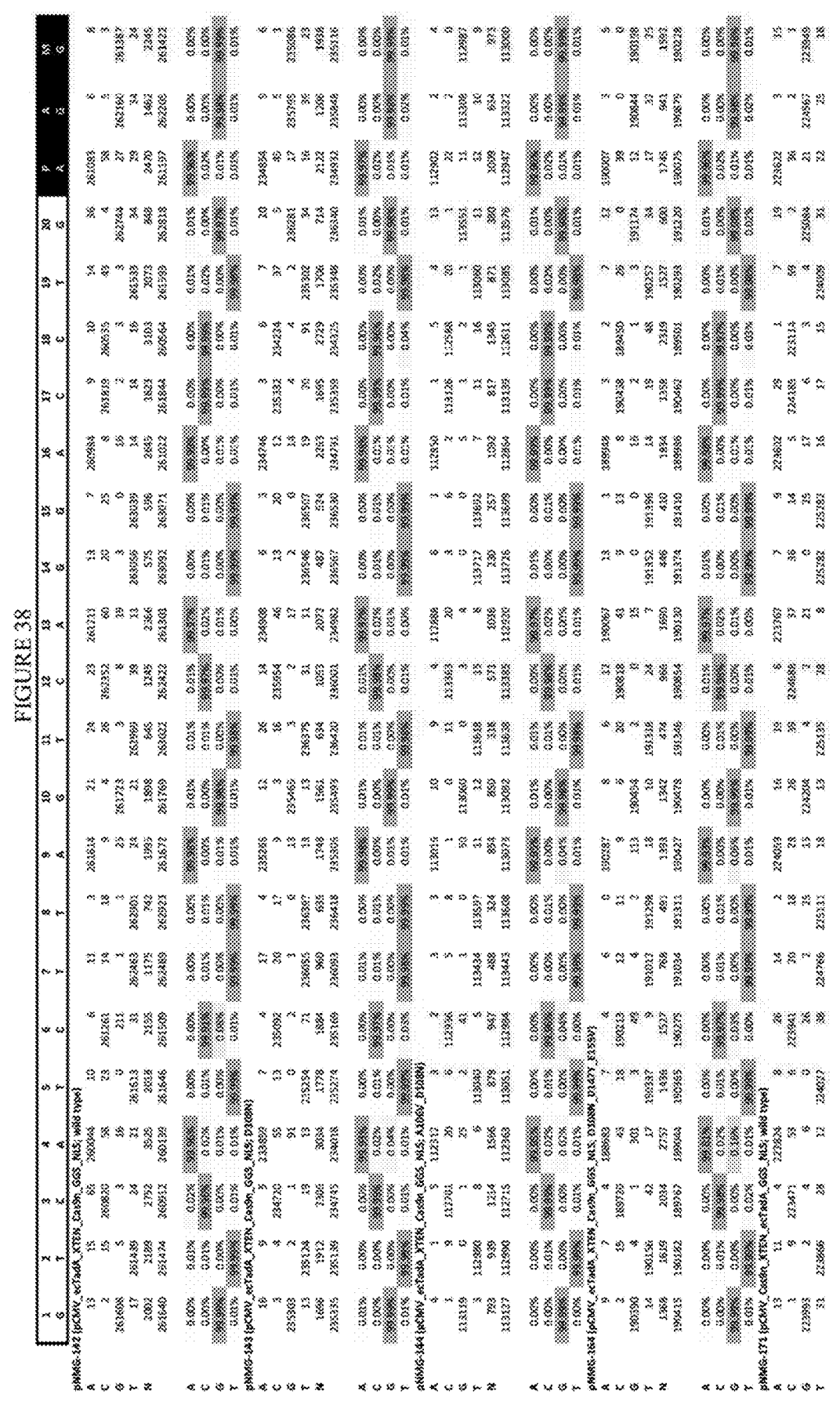
Figure 38:
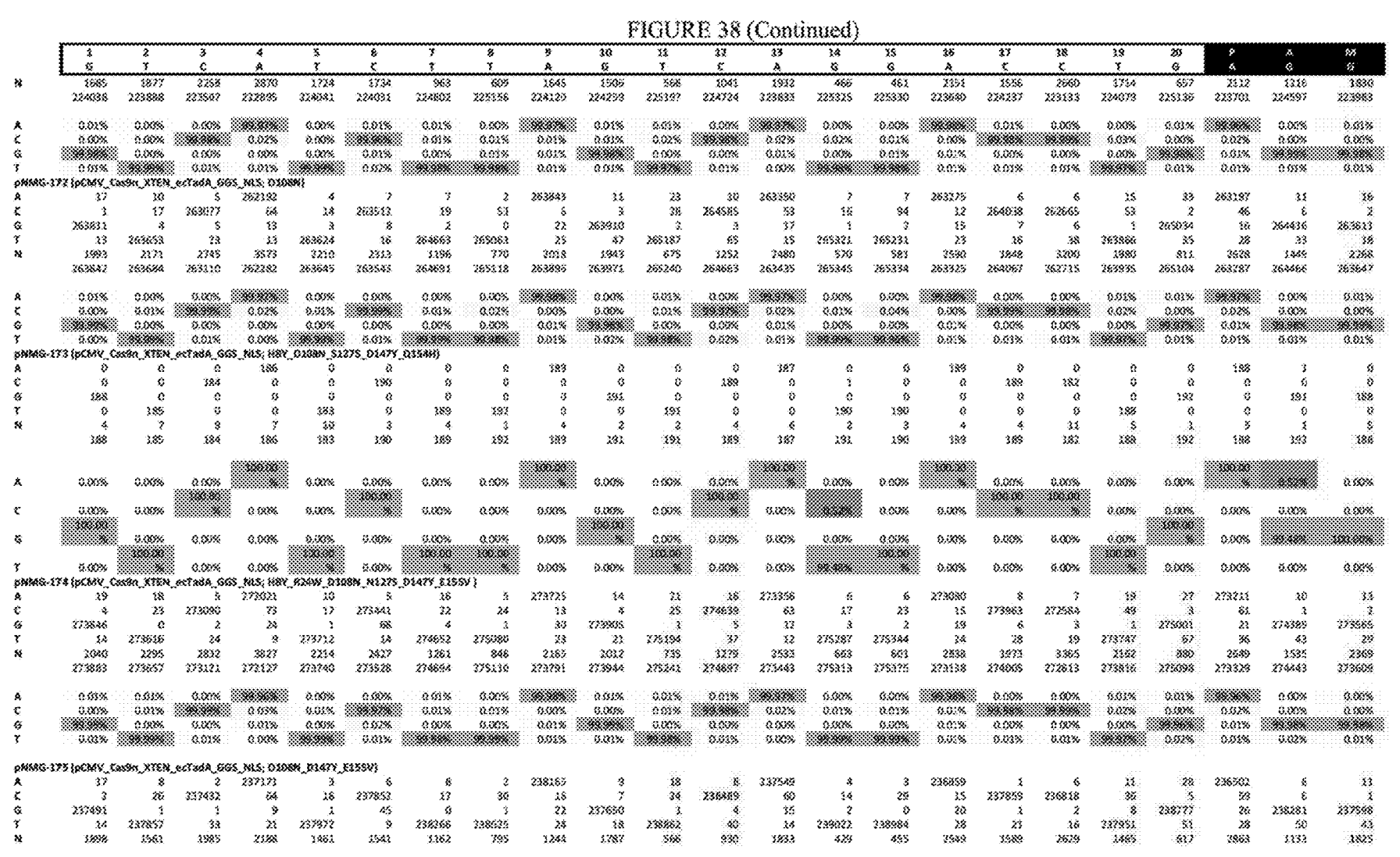
Figure 38:
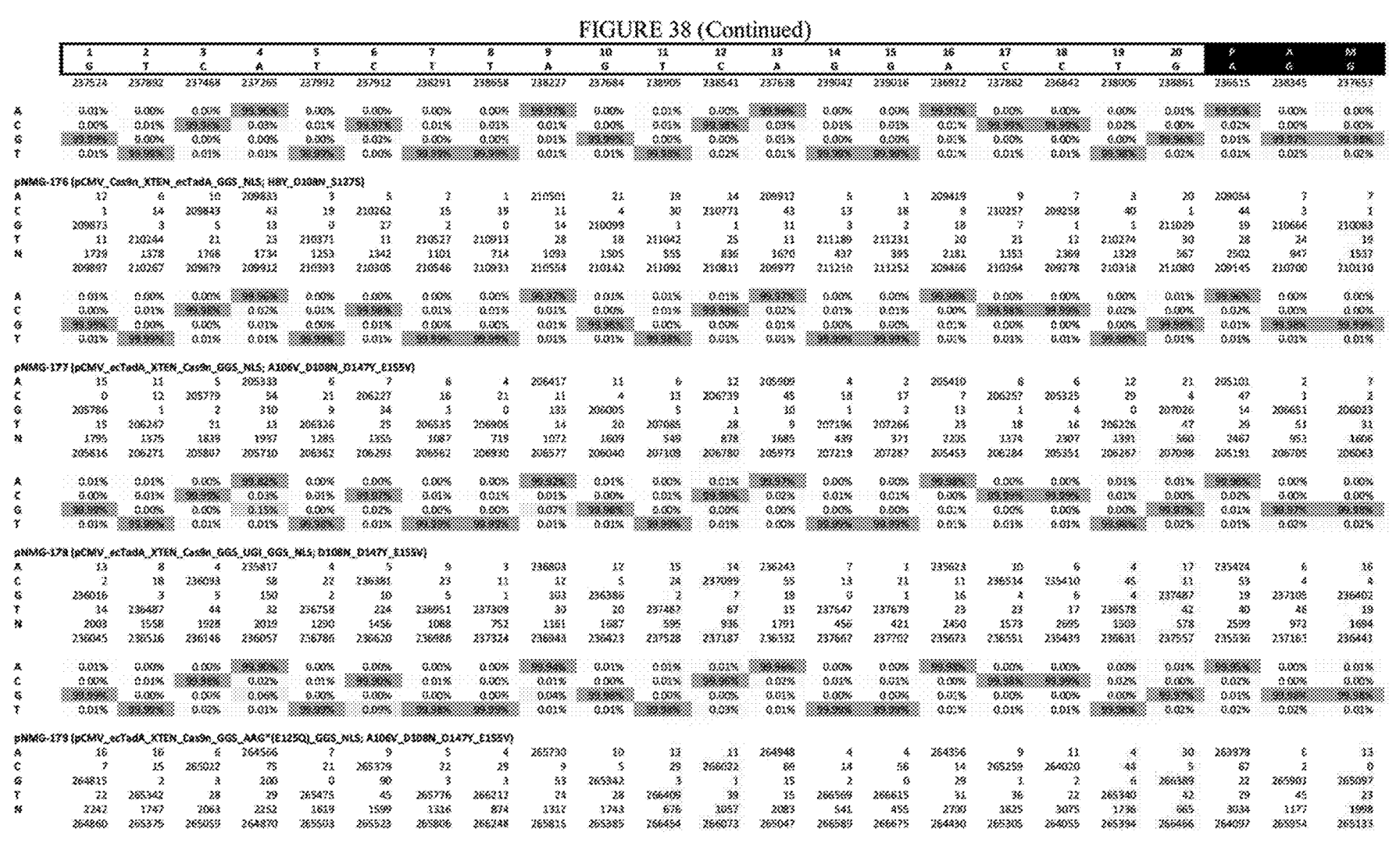
Figure 38:
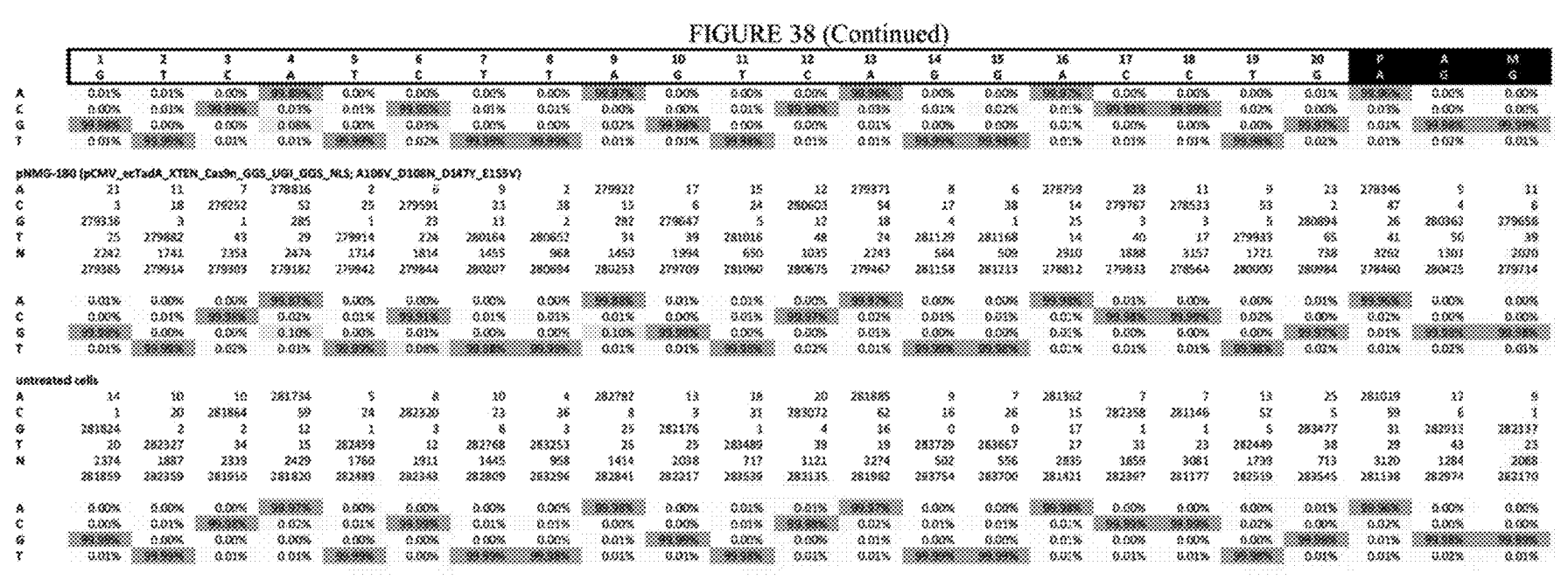

FIG. 38 shows the results of C-terminal fusion at the RNF-2 site. The sequence corresponds to SEQ ID NO: 44.

Figure 39:
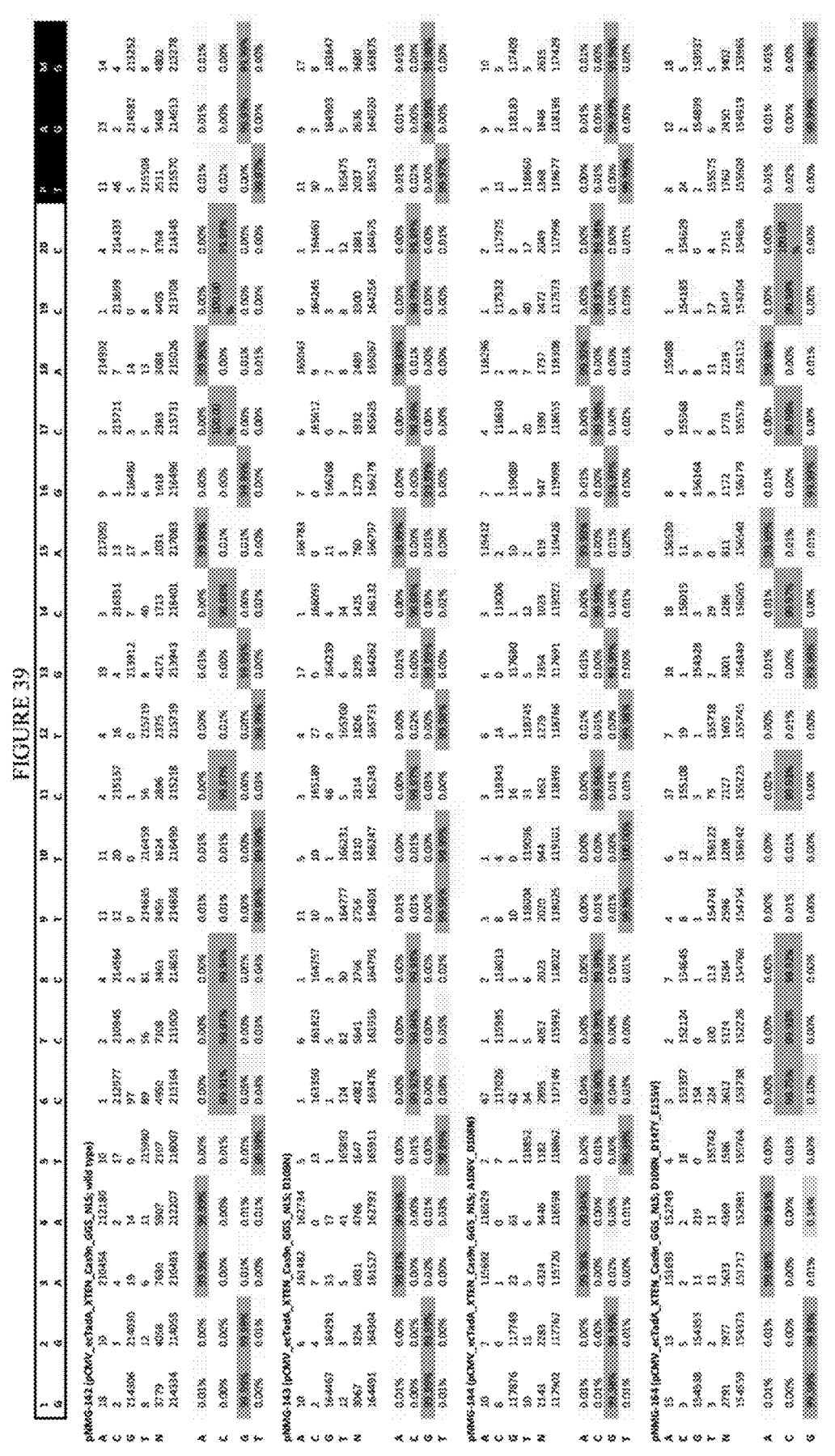
Figure 39:
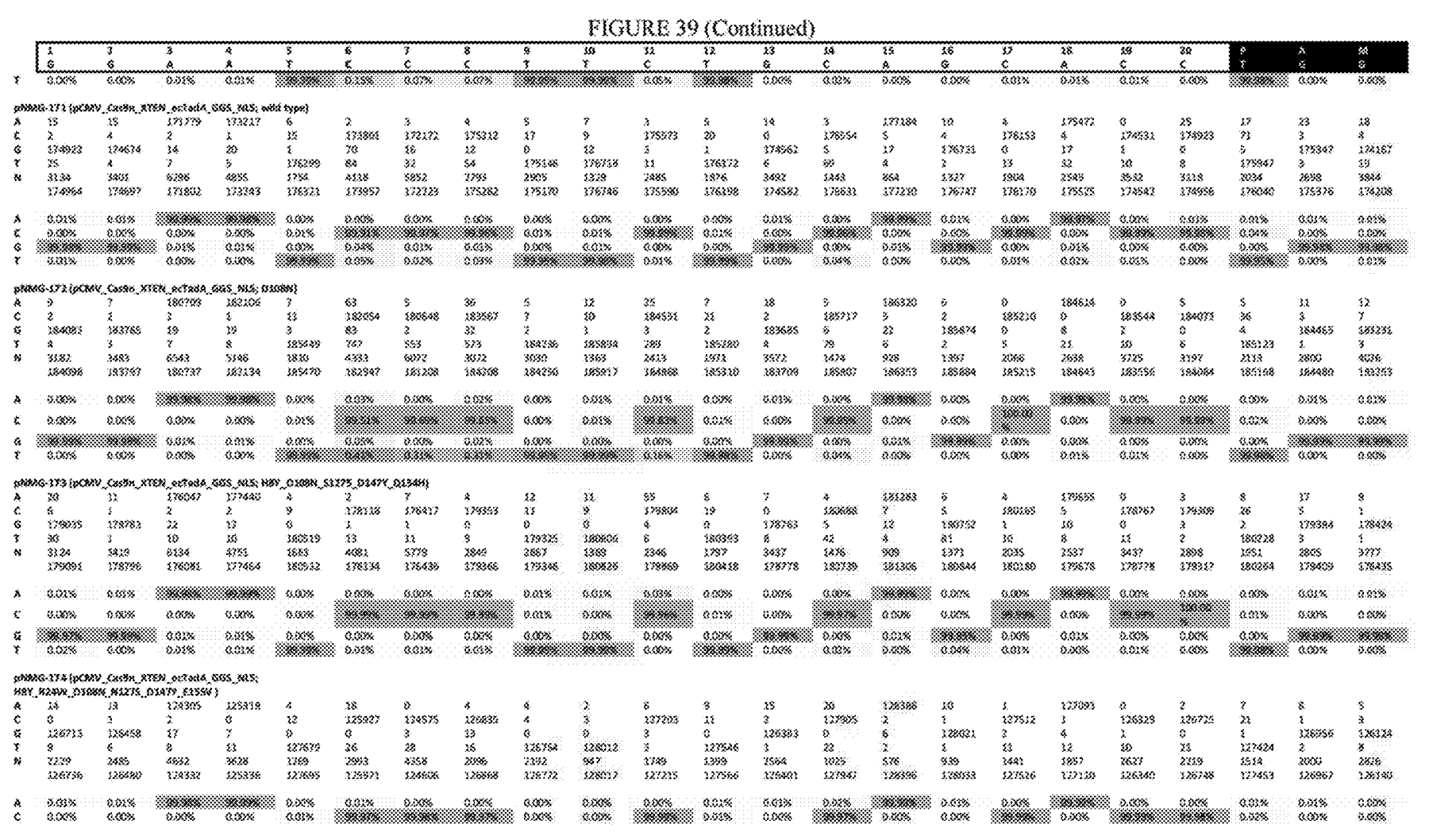
Figure 39:
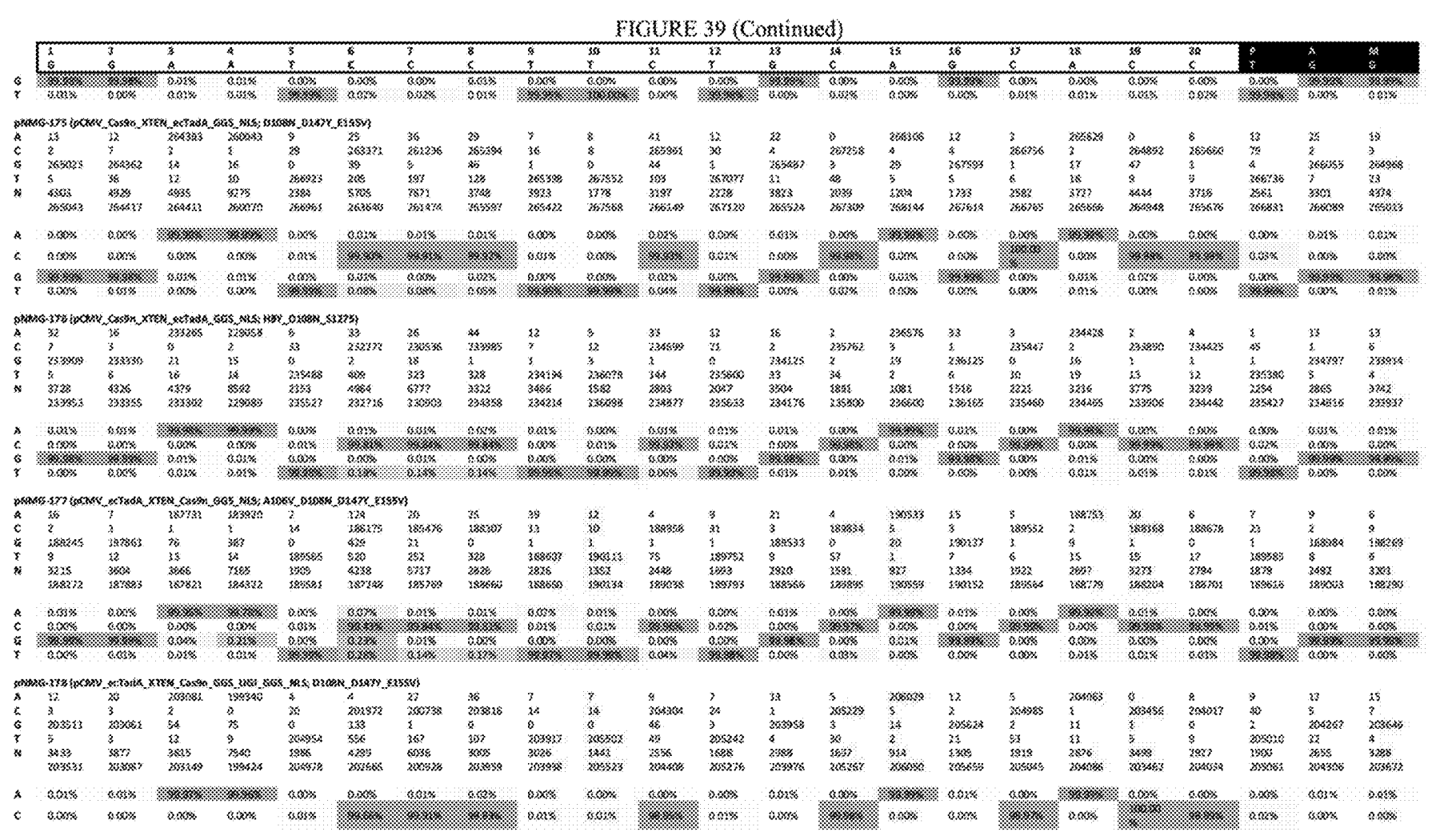
Figure 39:
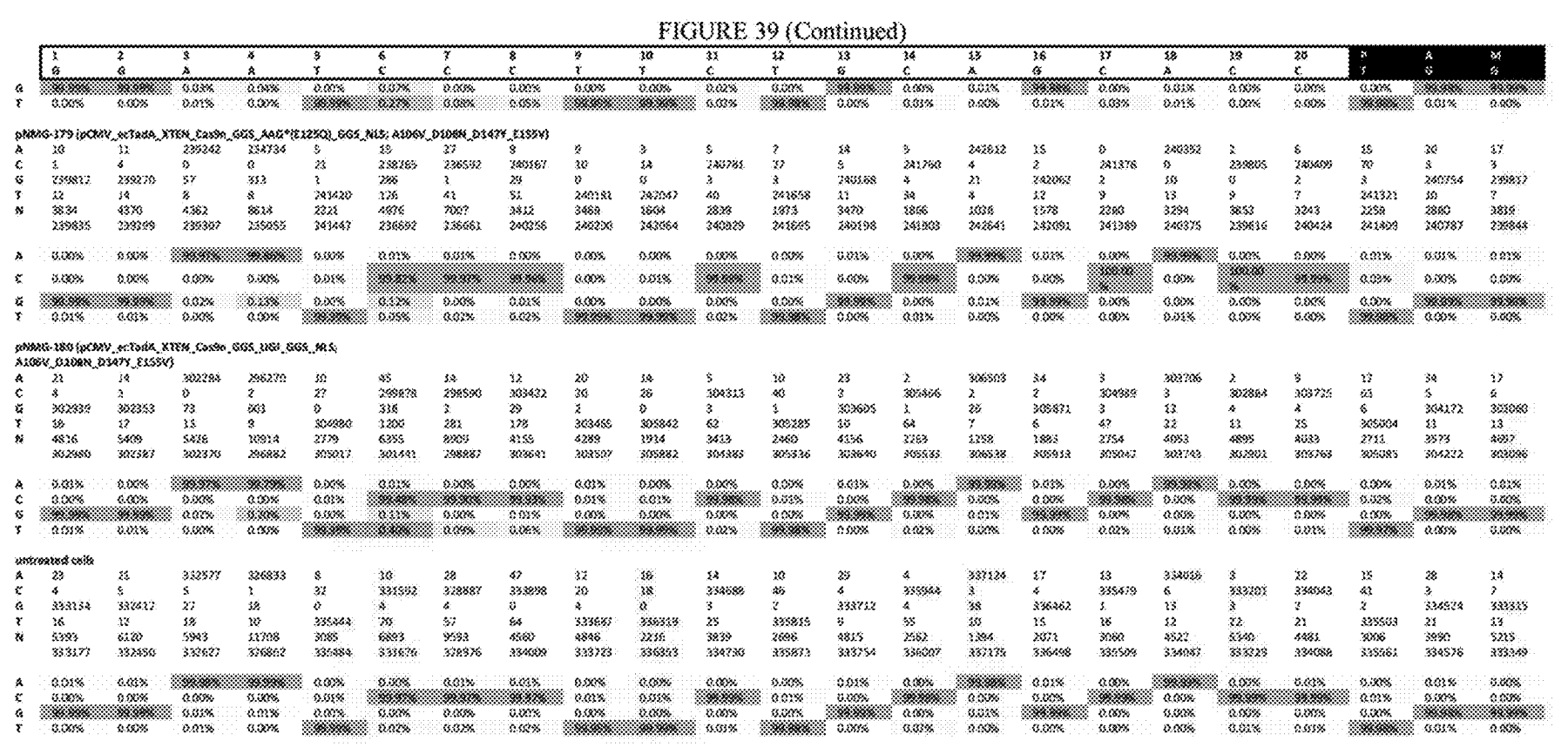

FIG. 39 shows the results of C-terminal fusion at the FANCF site. The sequence corresponds to SEQ ID NO: 45.

FIG. 40 shows the results of transfection at the Hek-2 site. The sequence corresponds to SEQ ID NO: 41.

Figure 41:
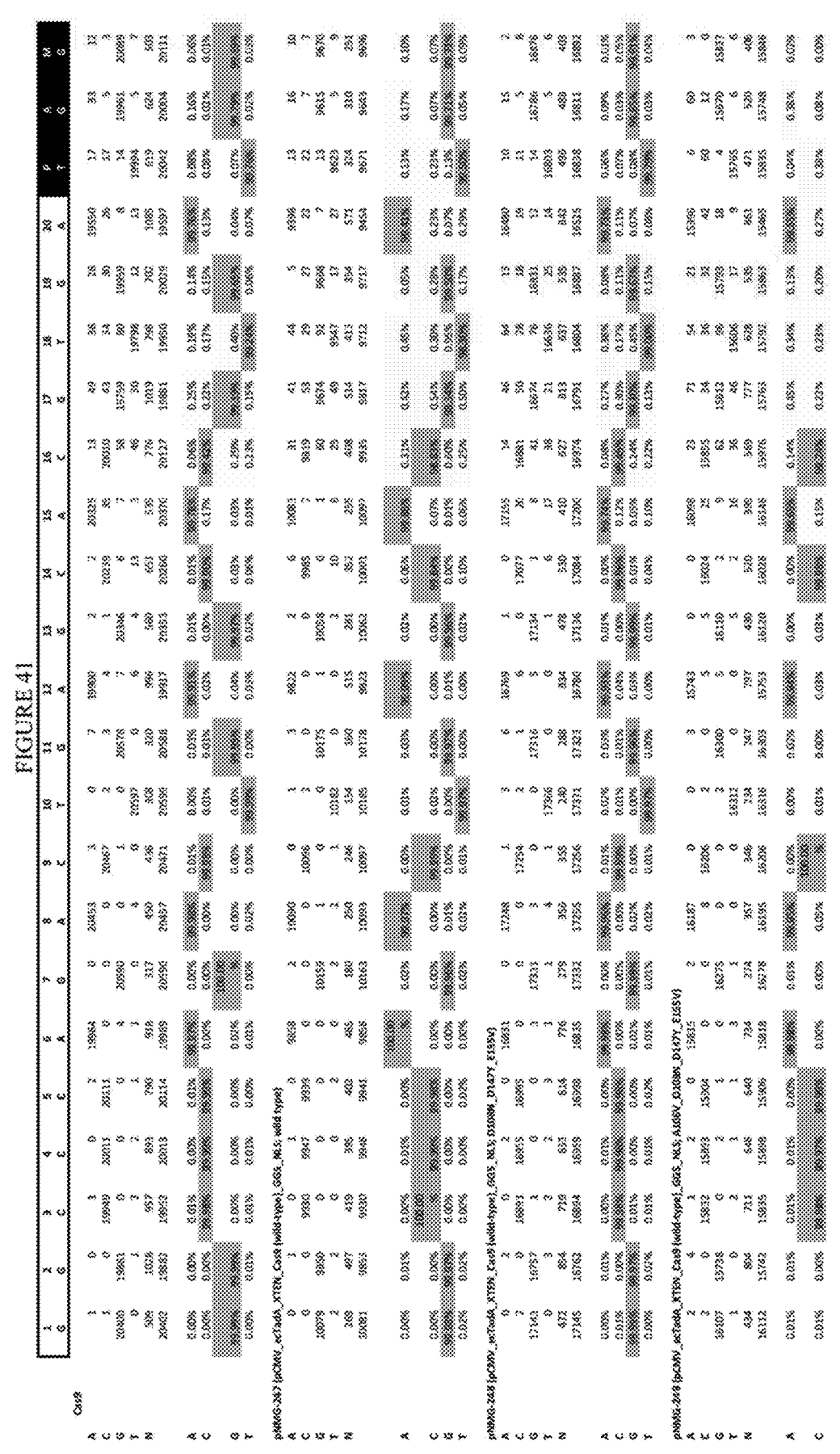
Figure 41:
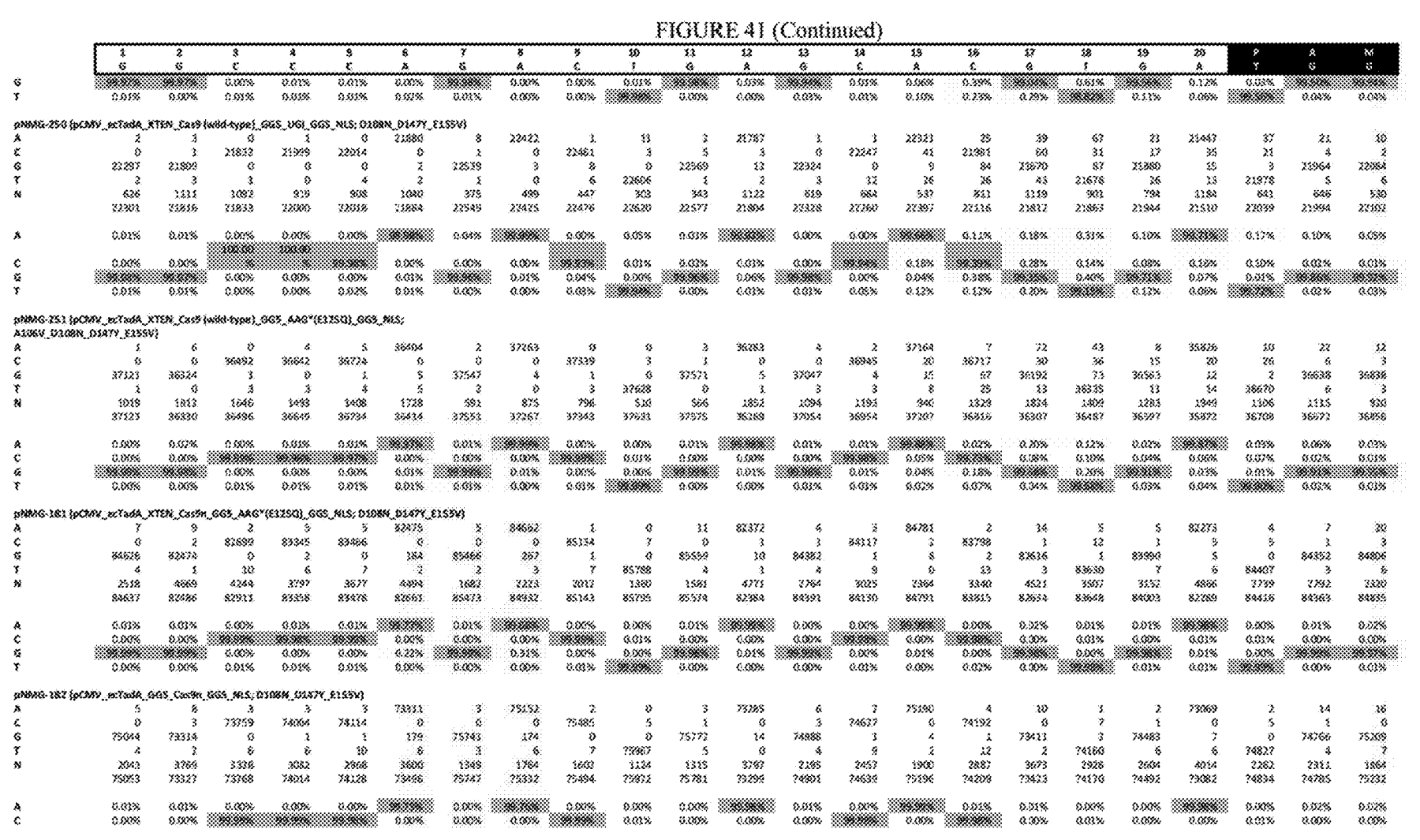
Figure 41:
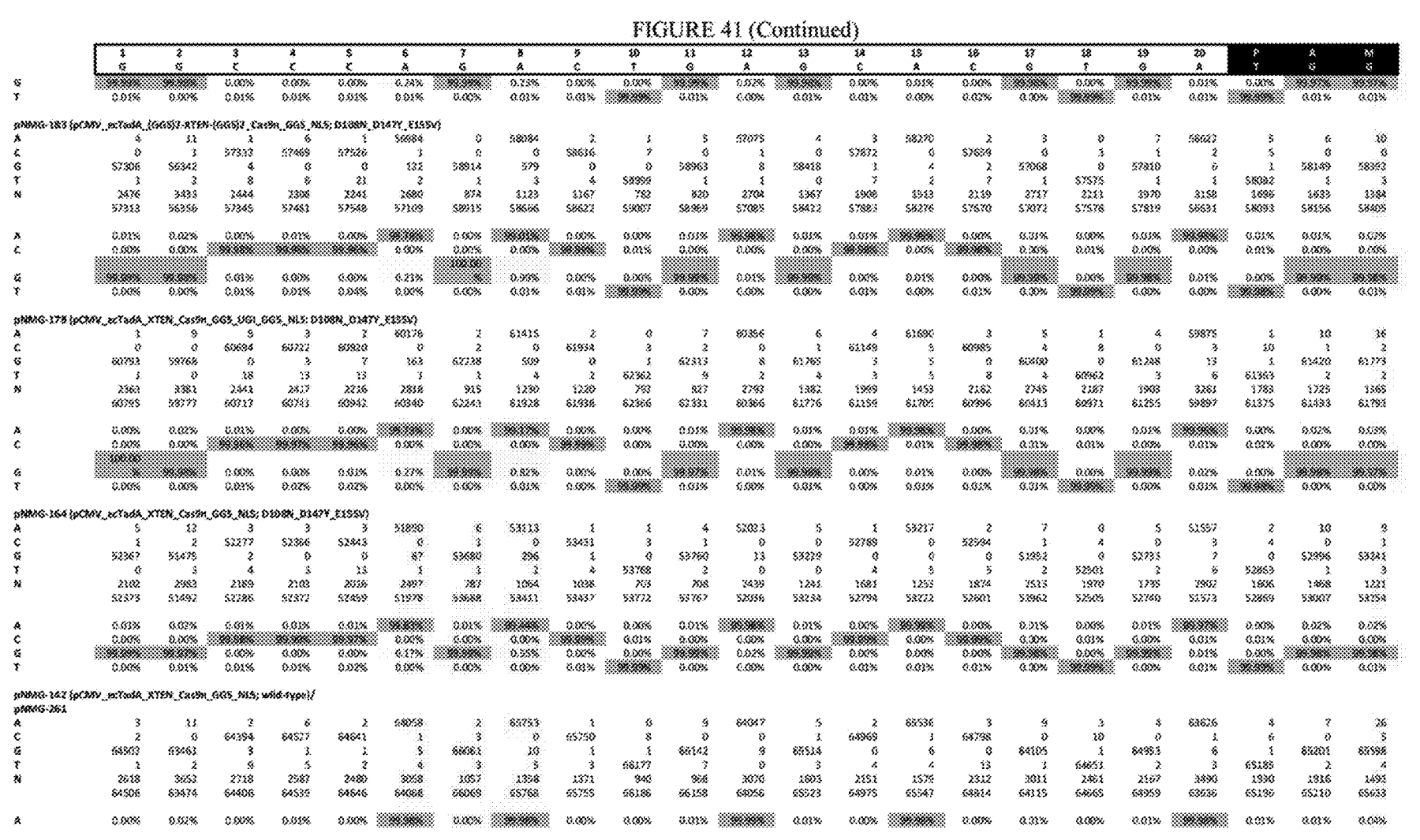
Figure 41:
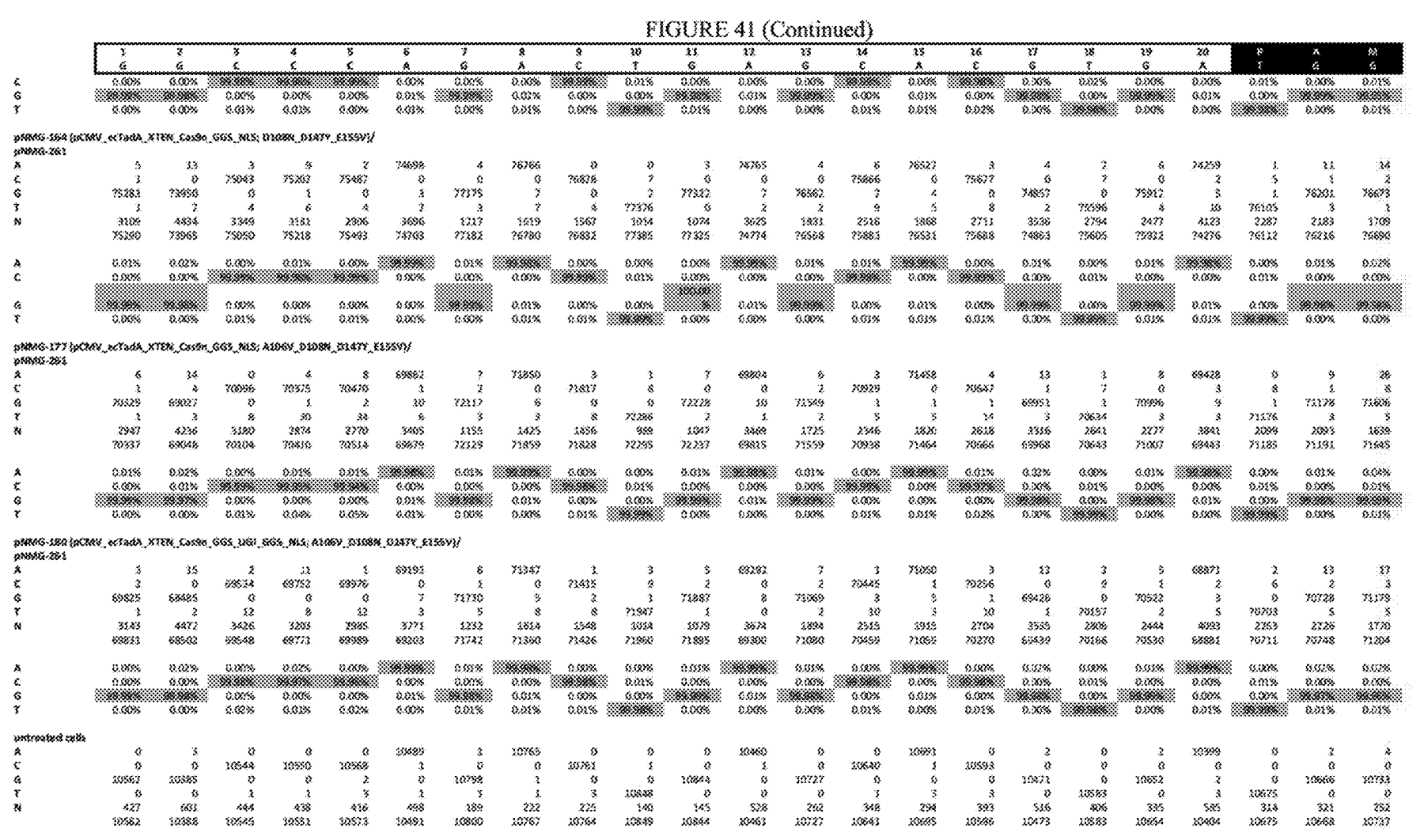
Figure 41:
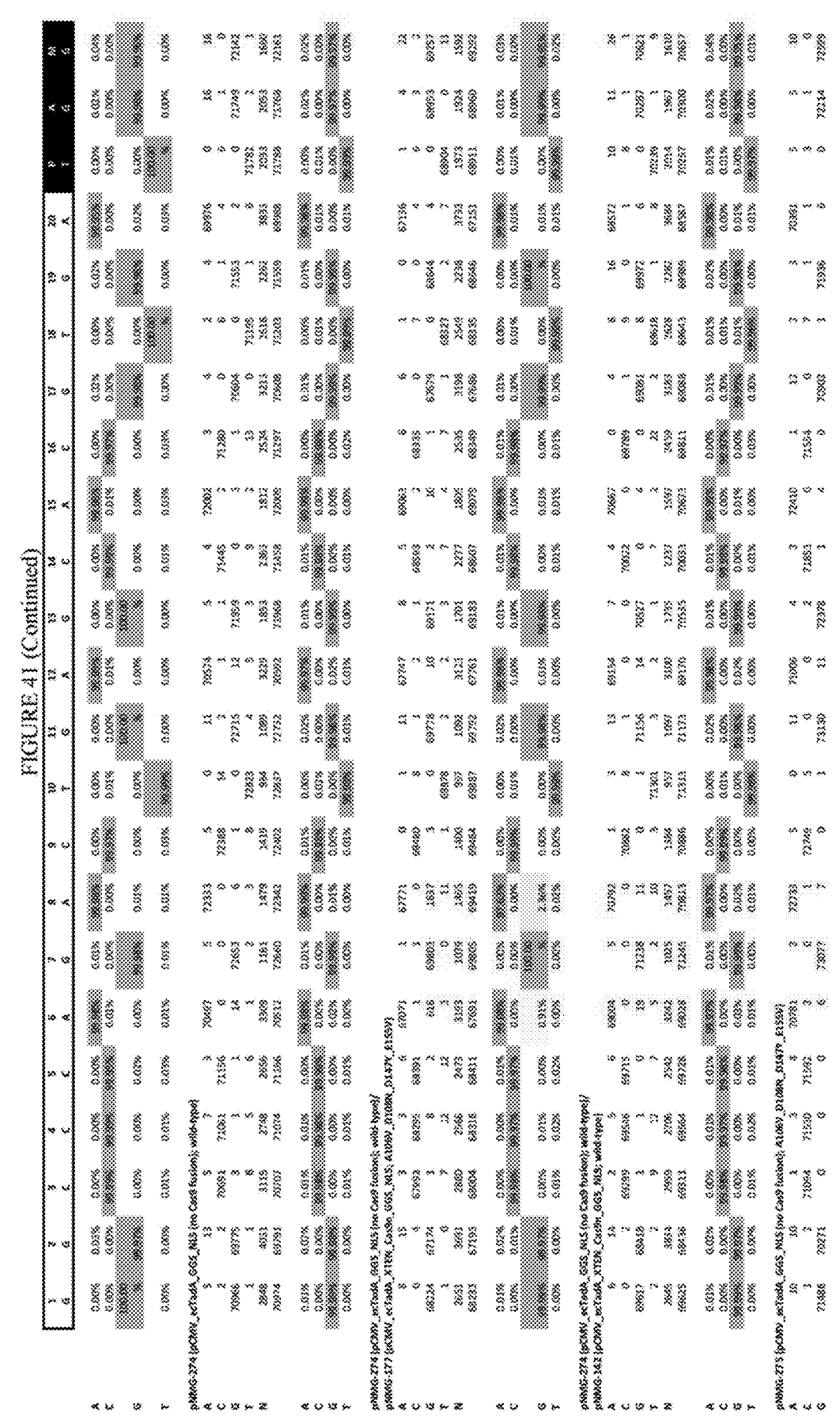
Figure 41:
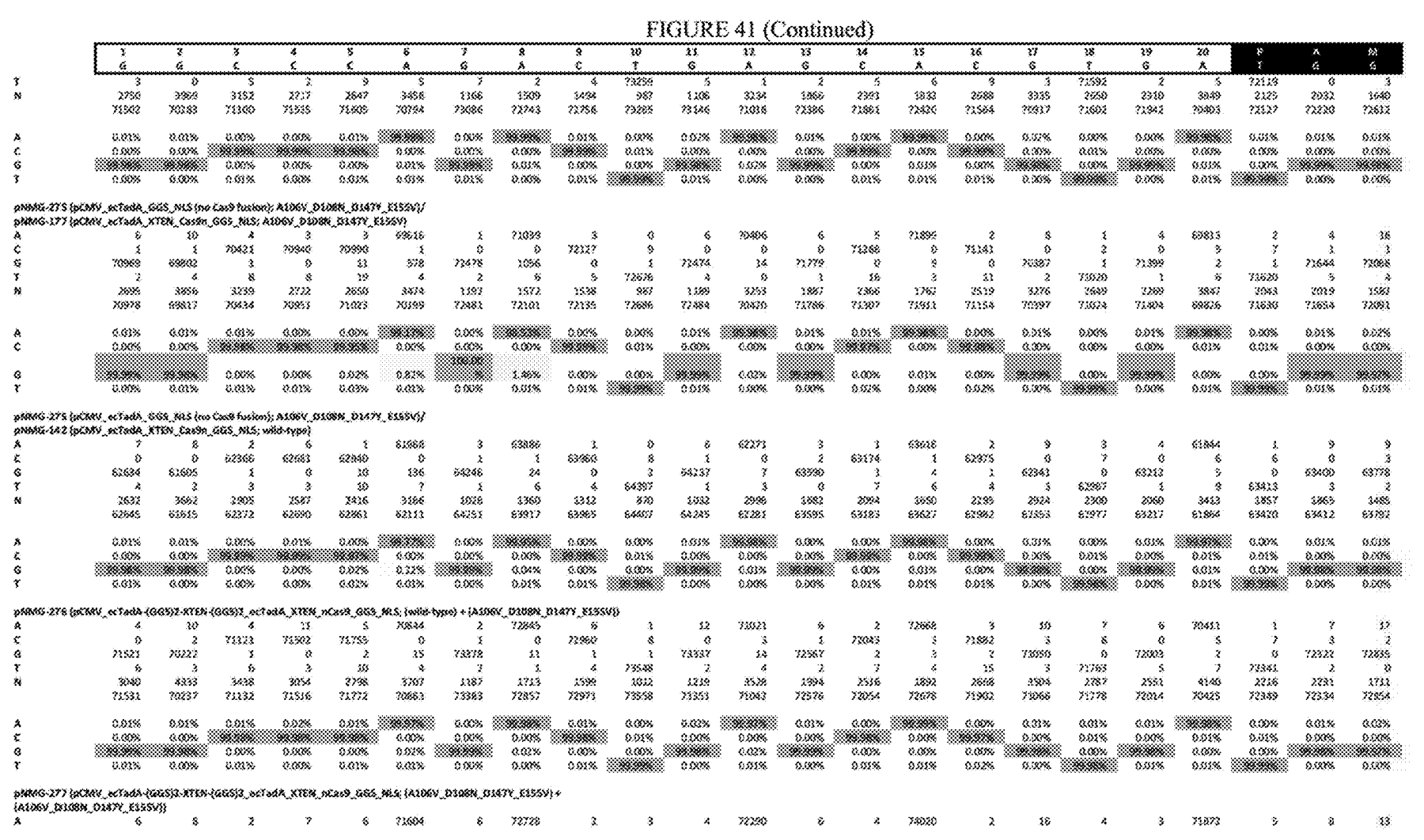
Figure 41:
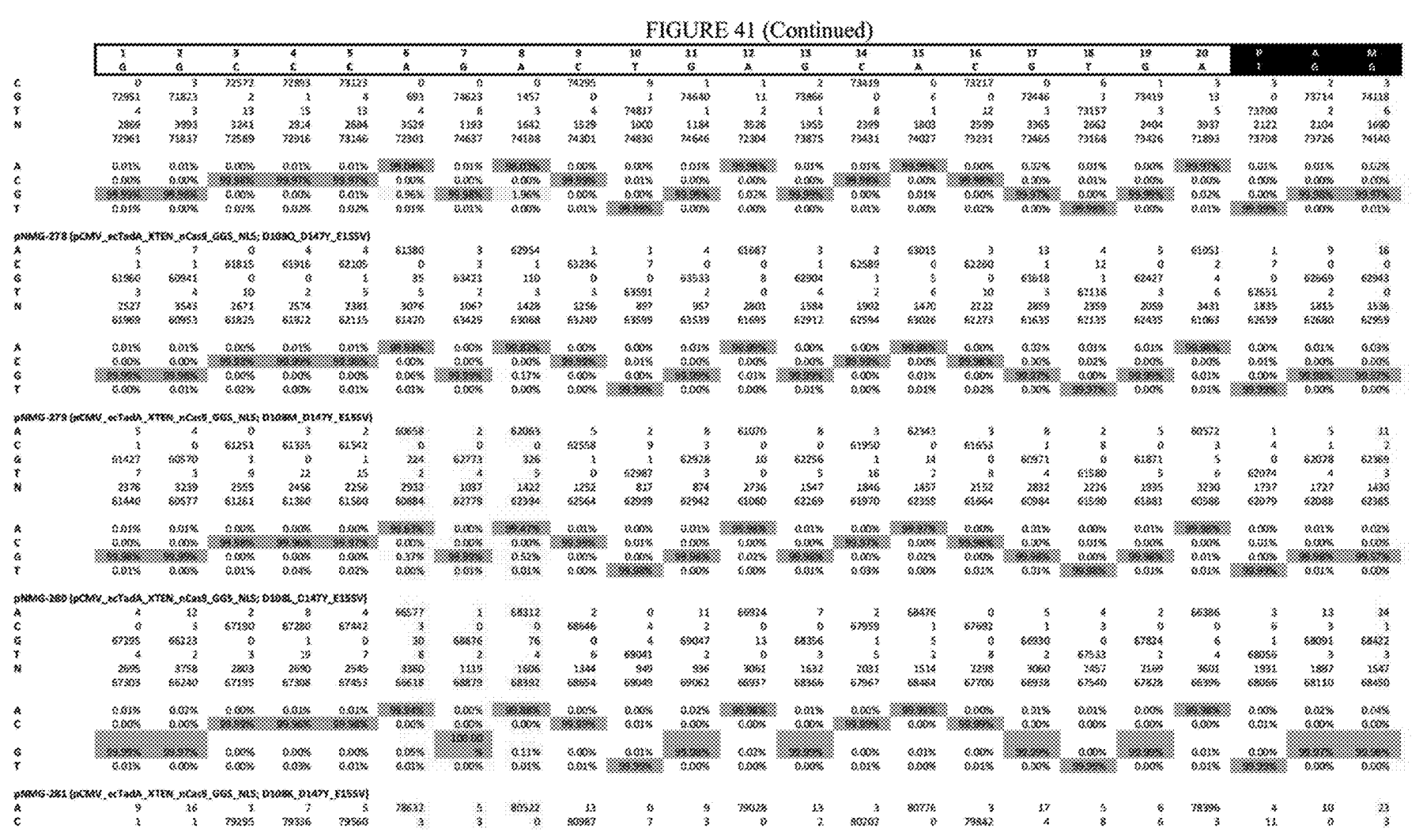
Figure 41:
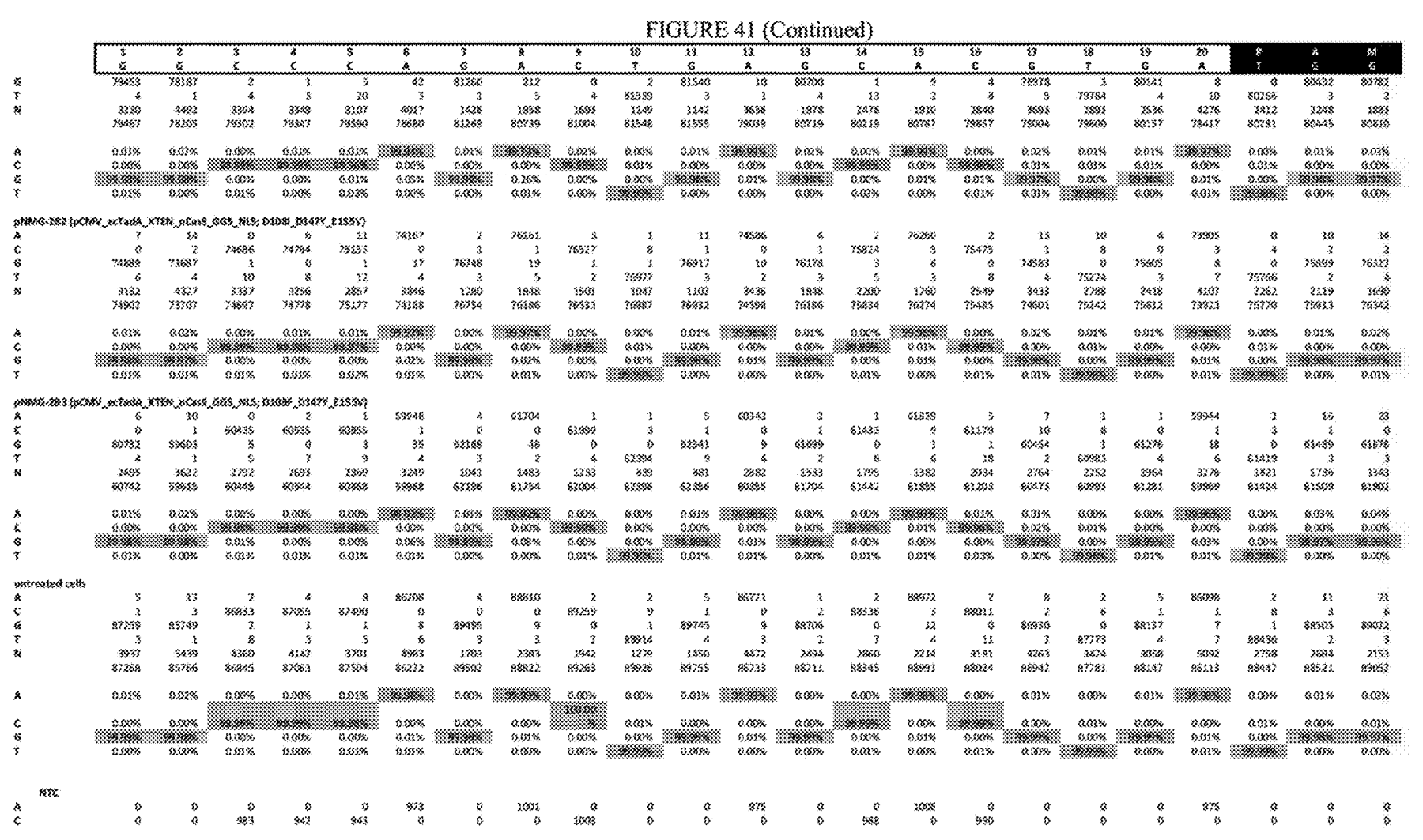
Figure 41:
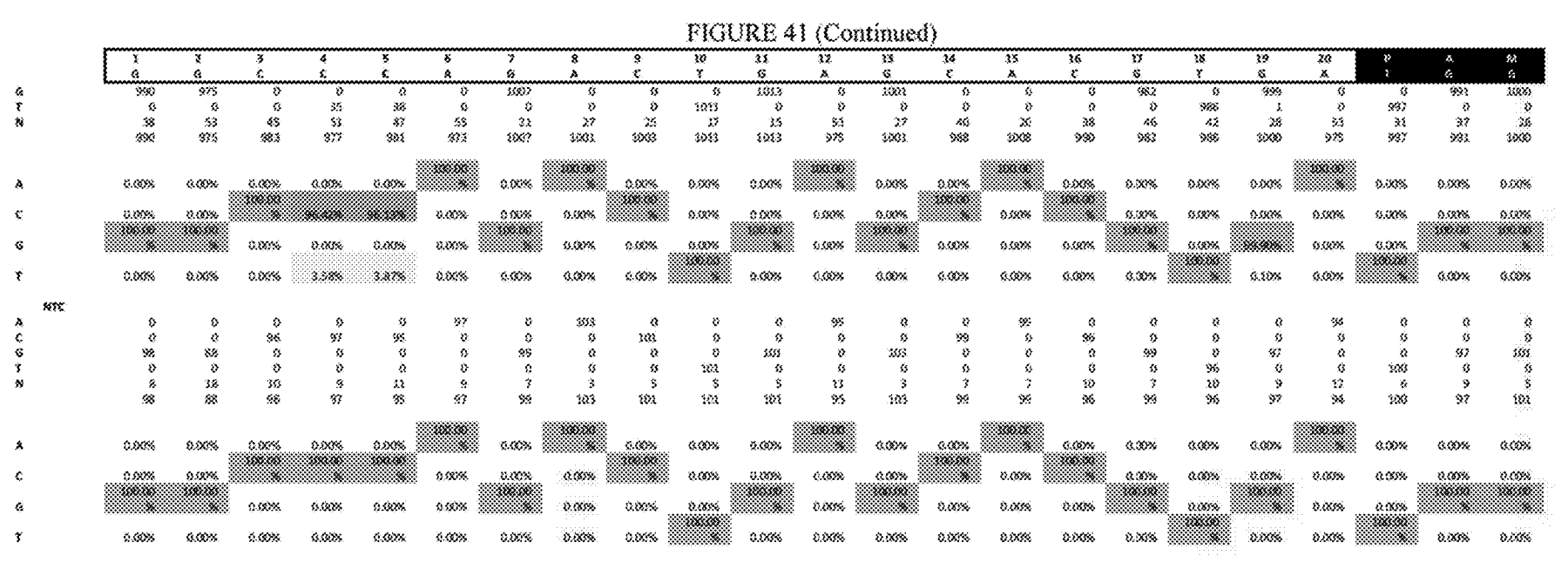

FIG. 41 shows the results of transfection at the Hek-3 site. The sequence corresponds to SEQ ID NO: 42.

Figure 42:
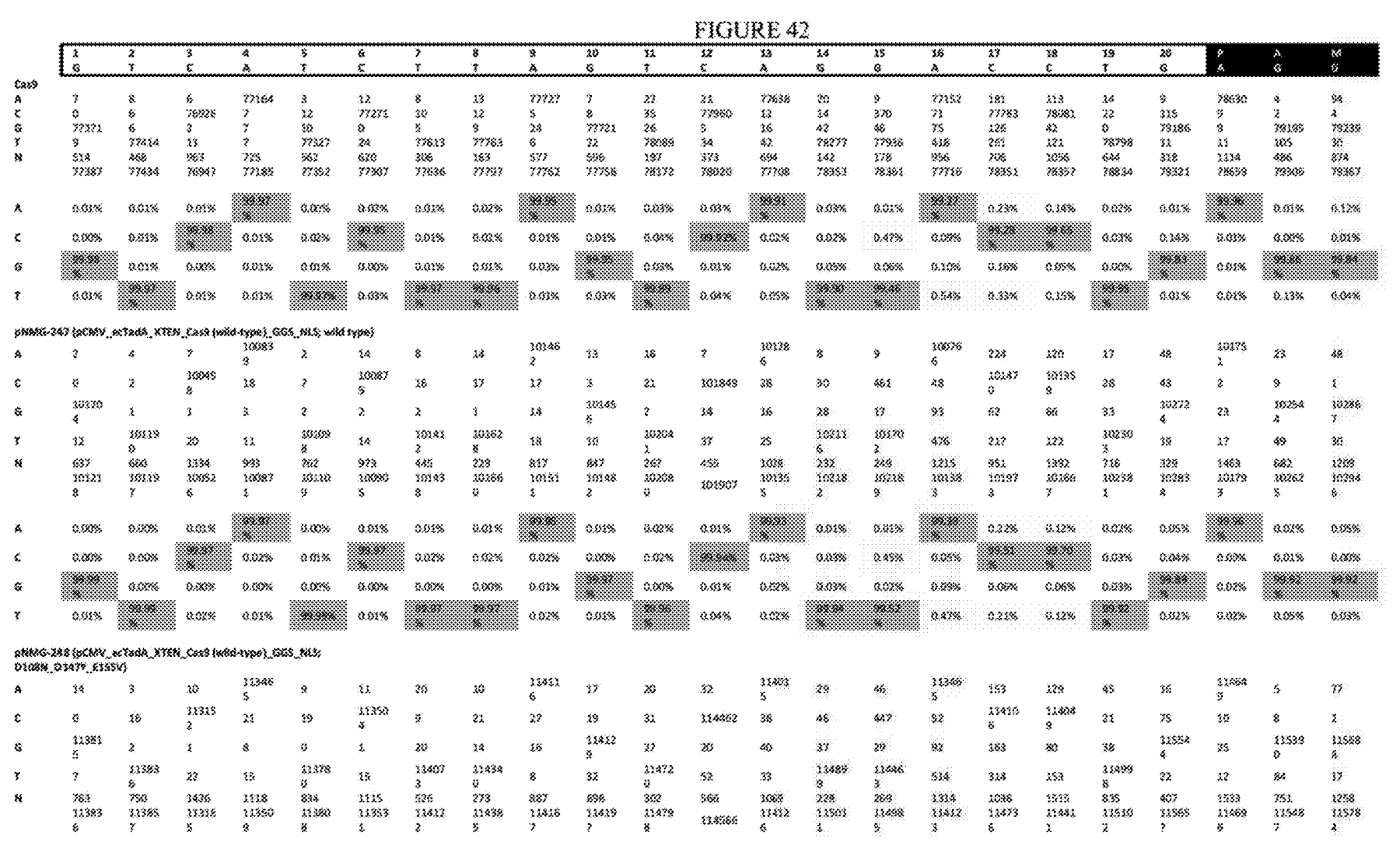
Figure 42:
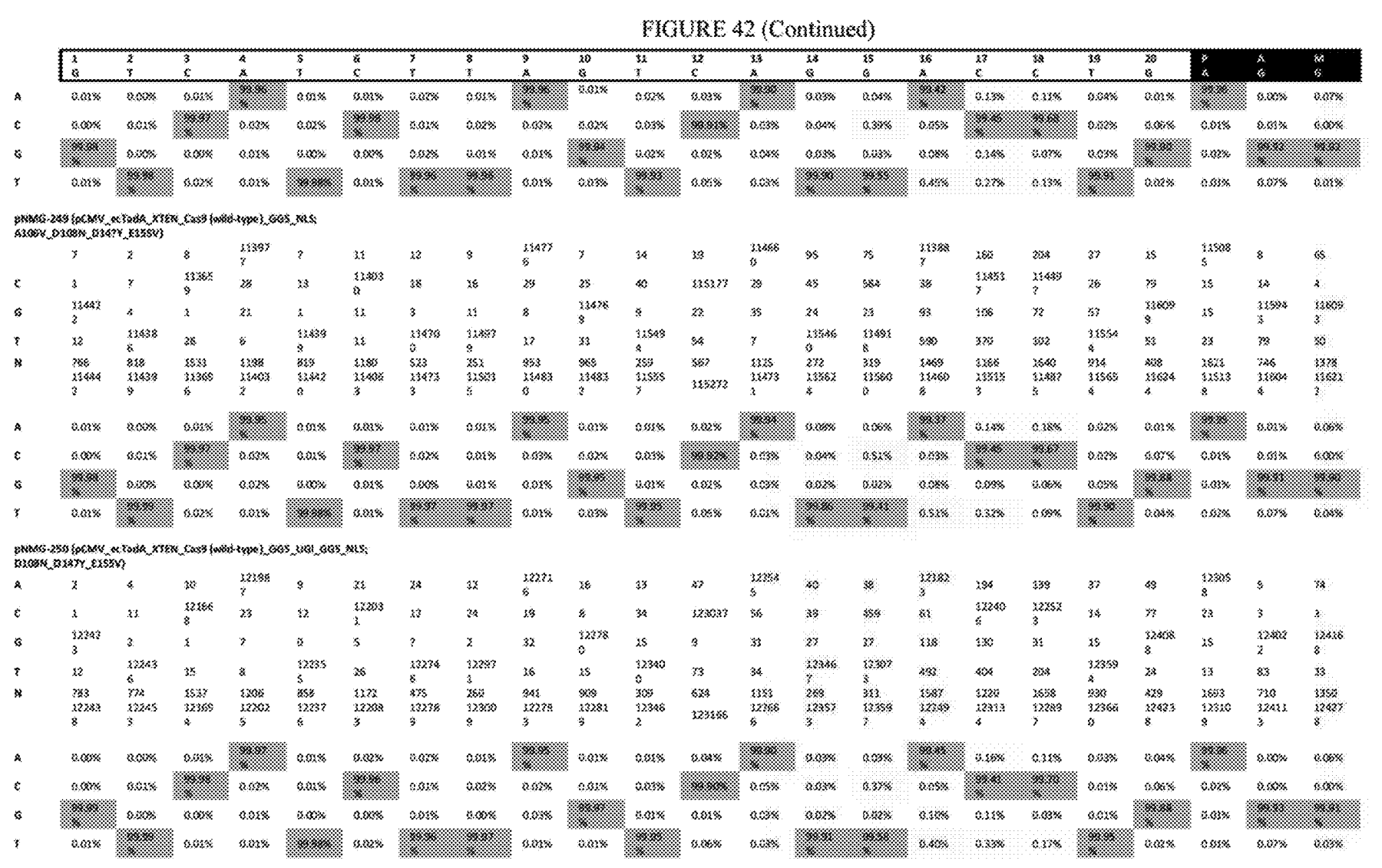
Figure 42:
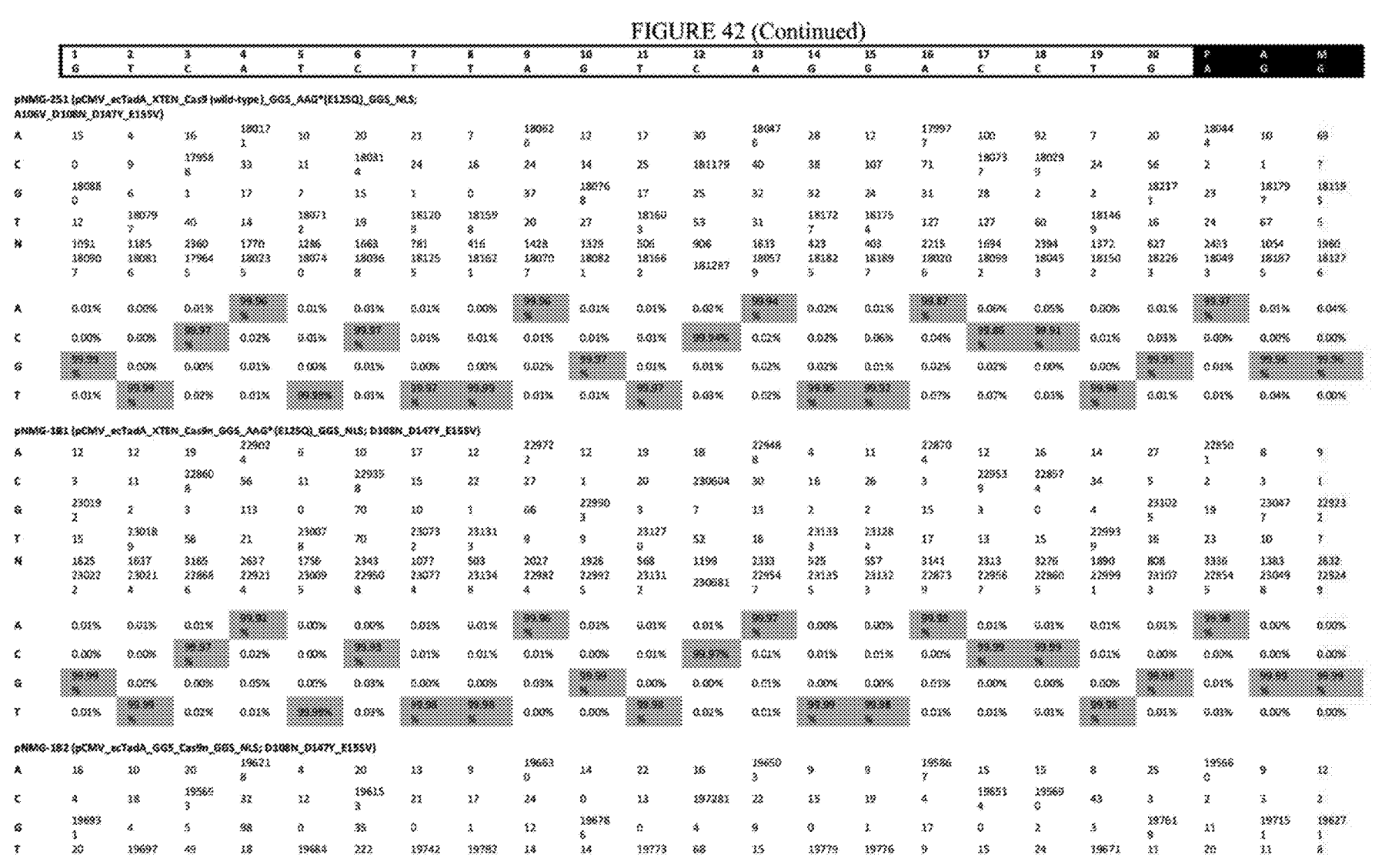
Figure 42:
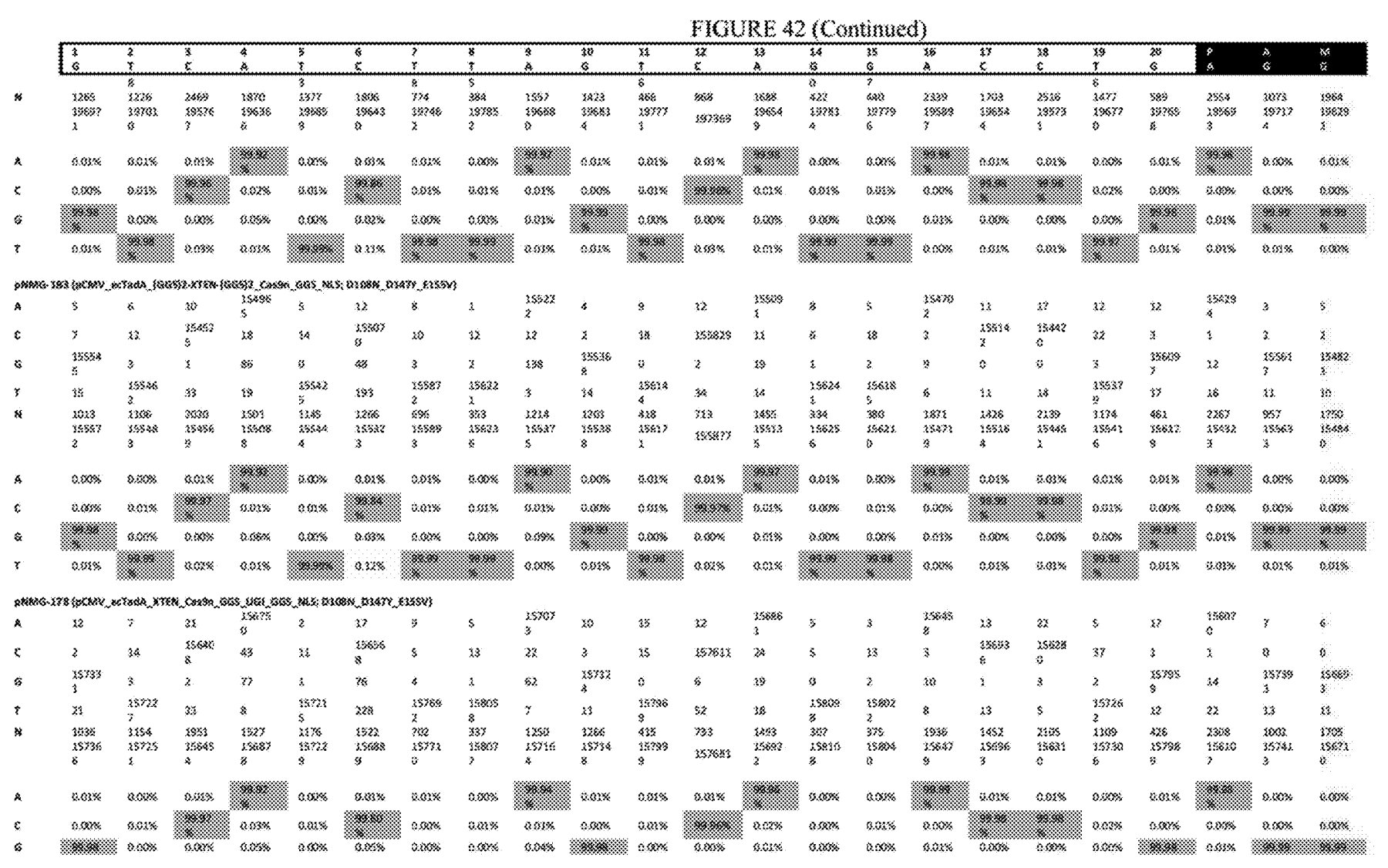
Figure 42:
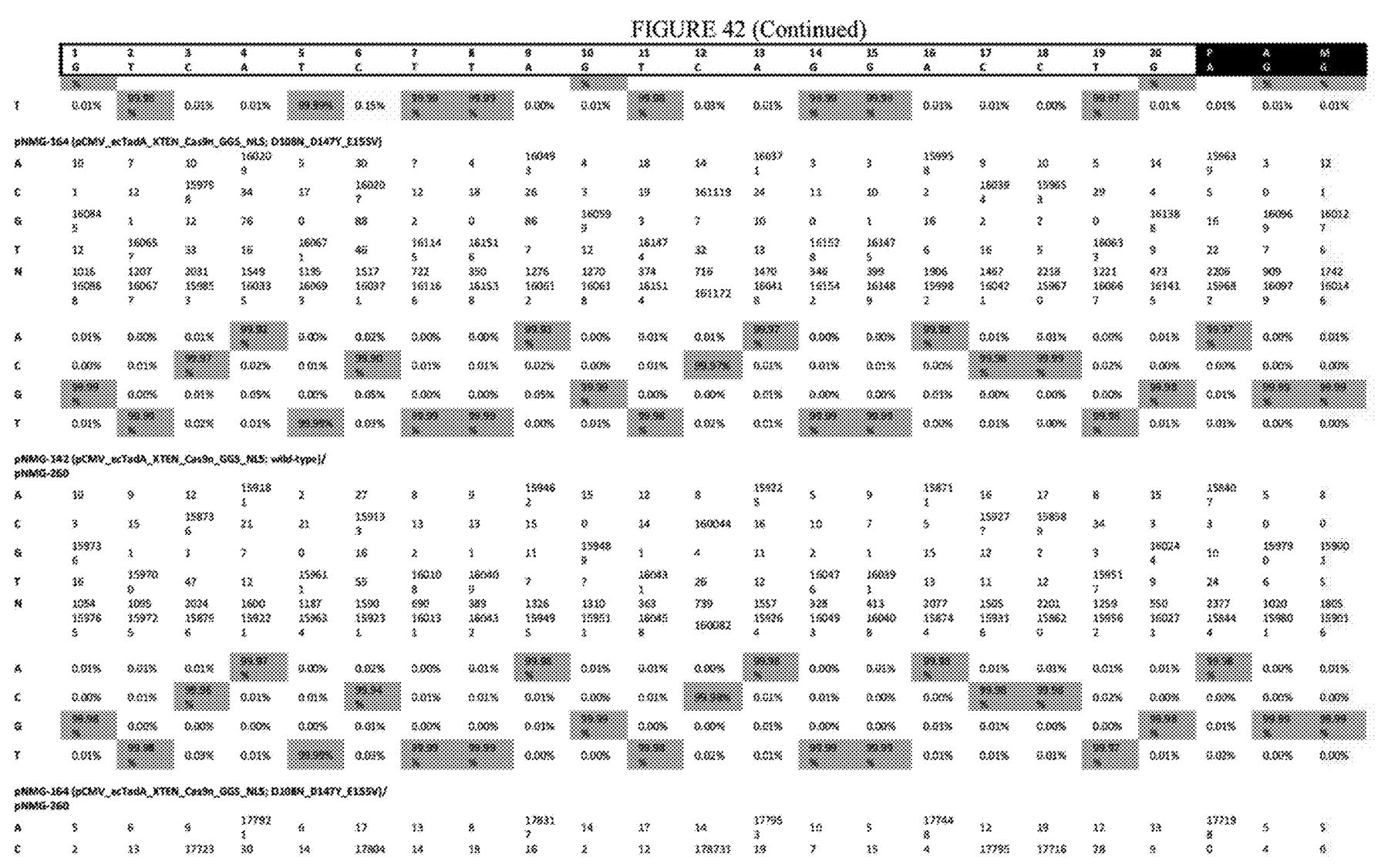
Figure 42:
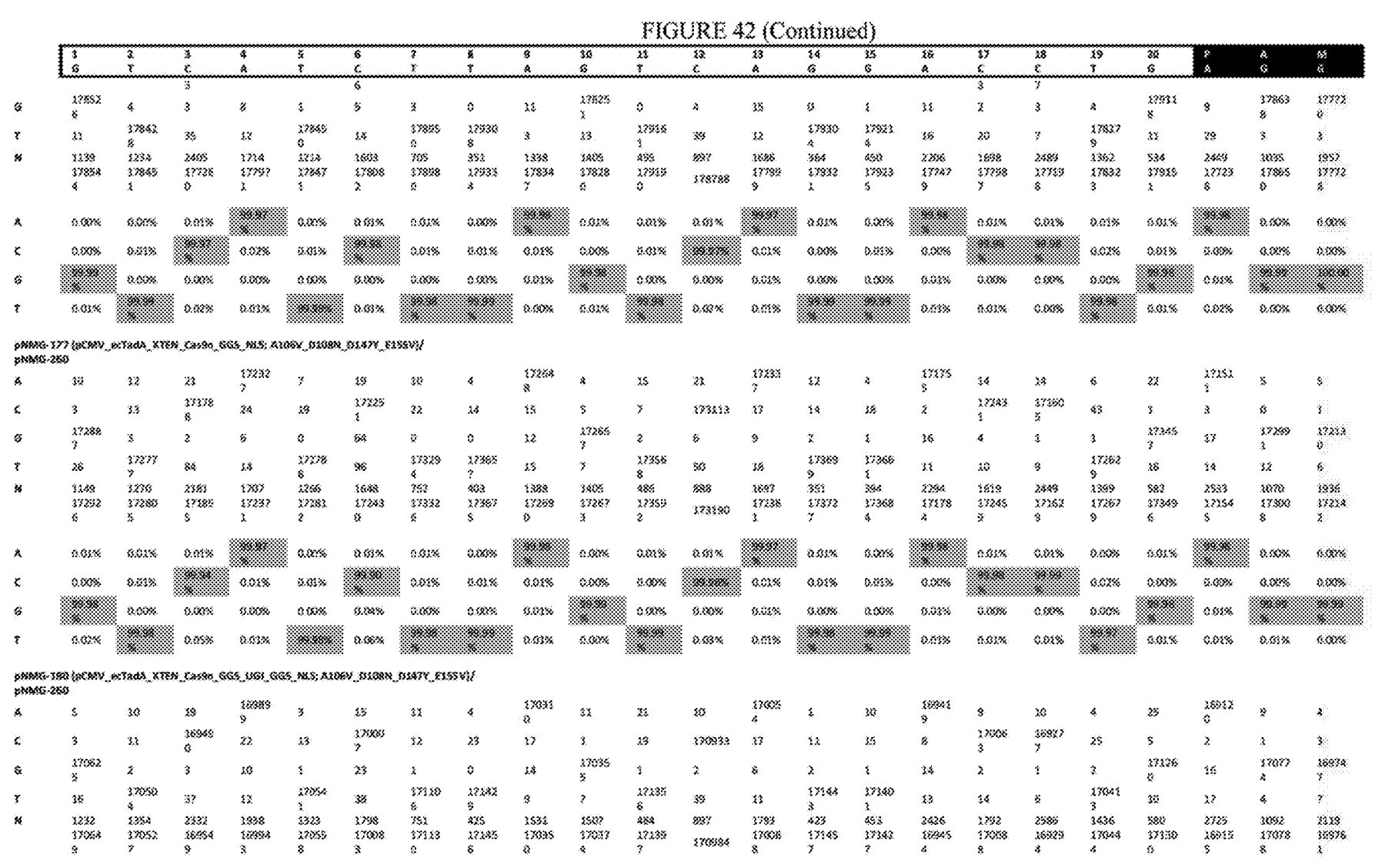
Figure 42:
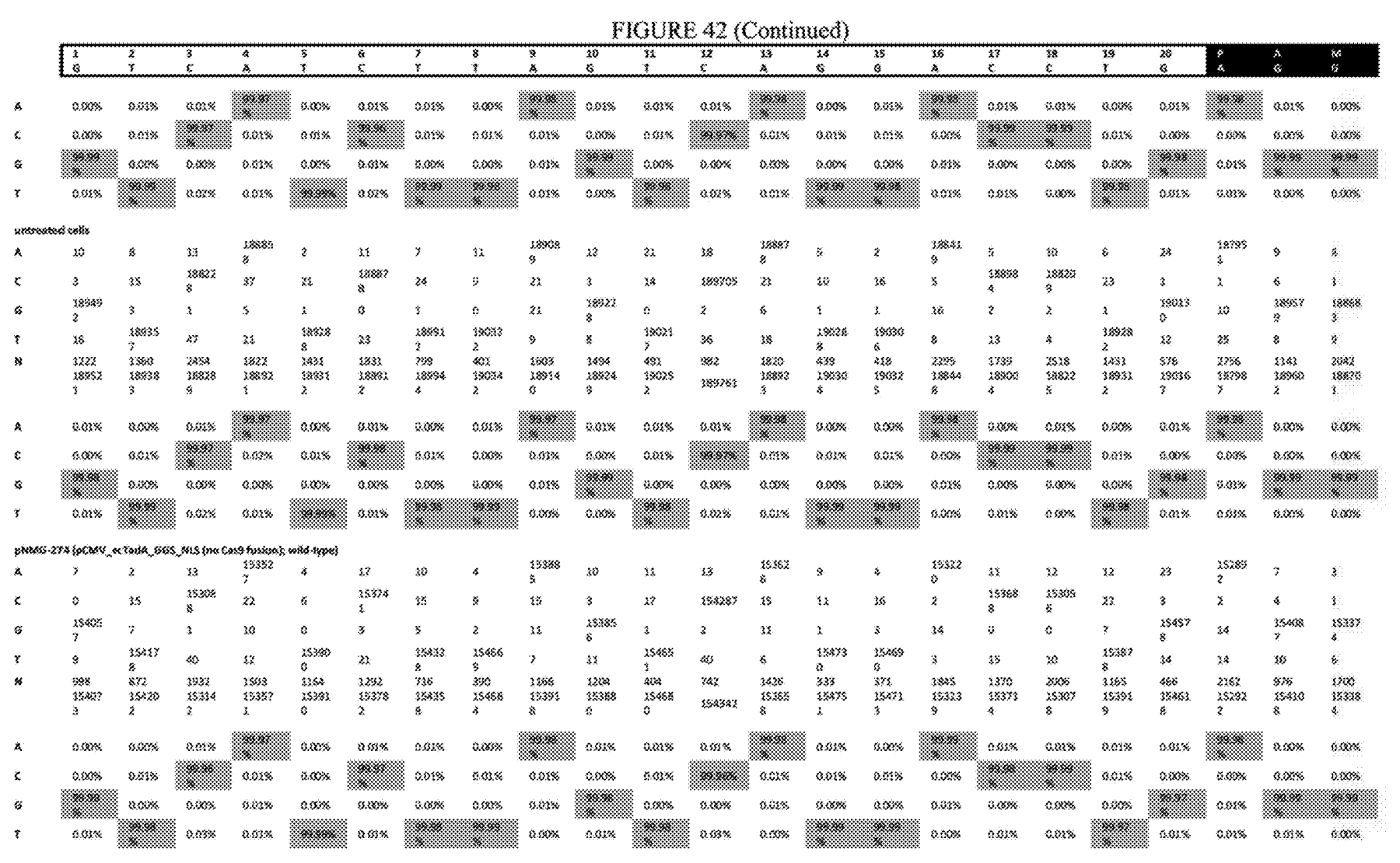
Figure 42:
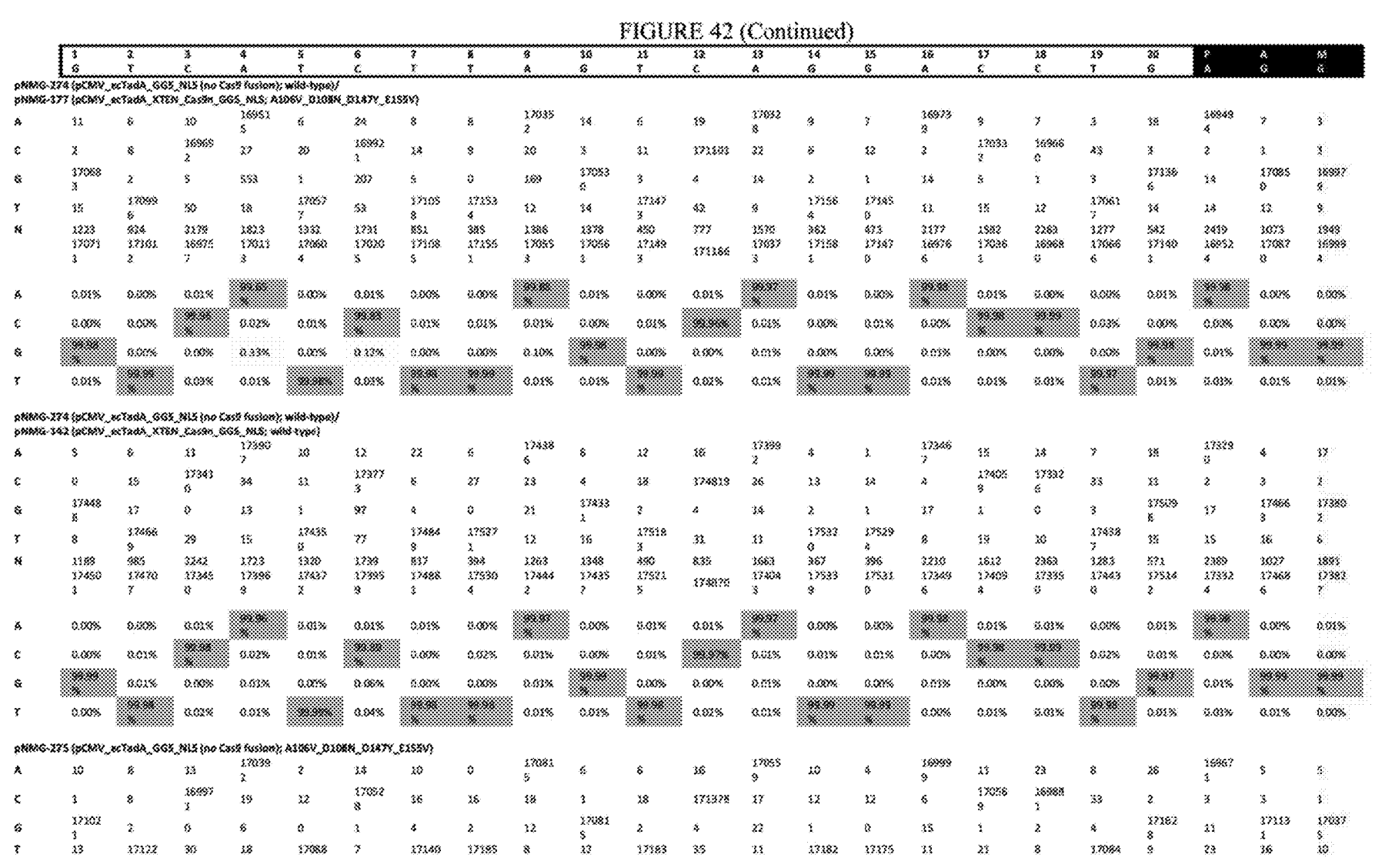
Figure 42:
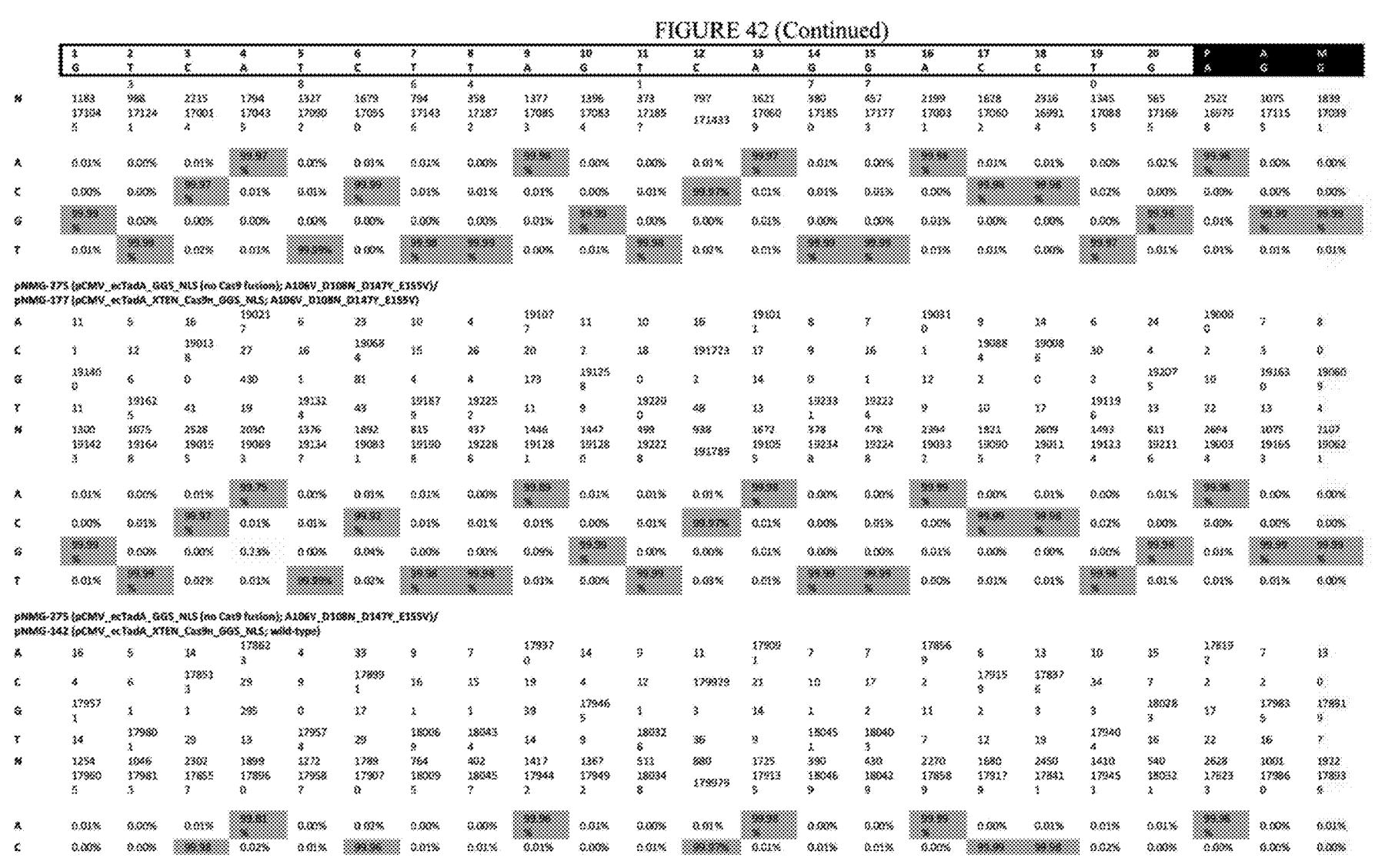
Figure 42:
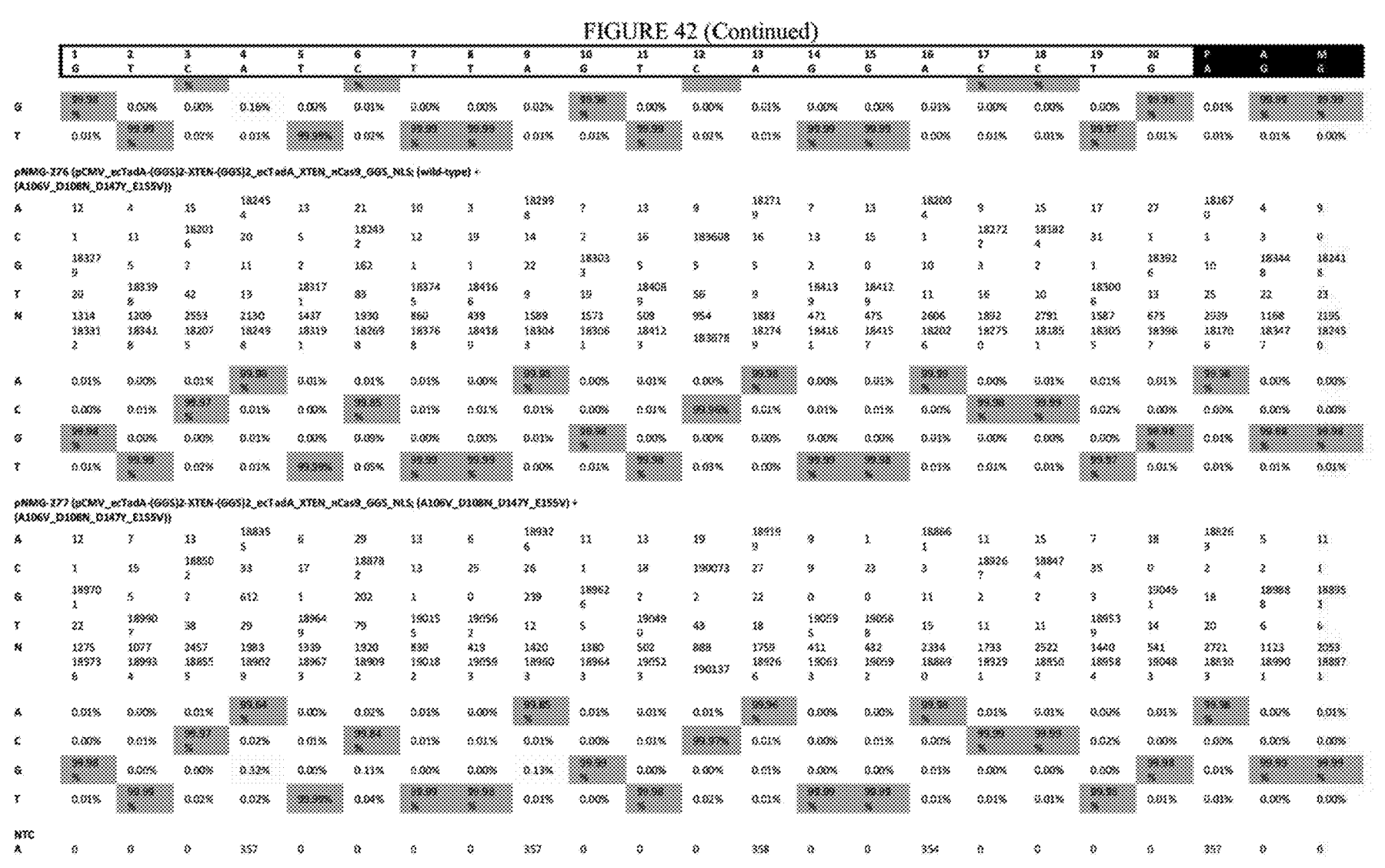
Figure 42:
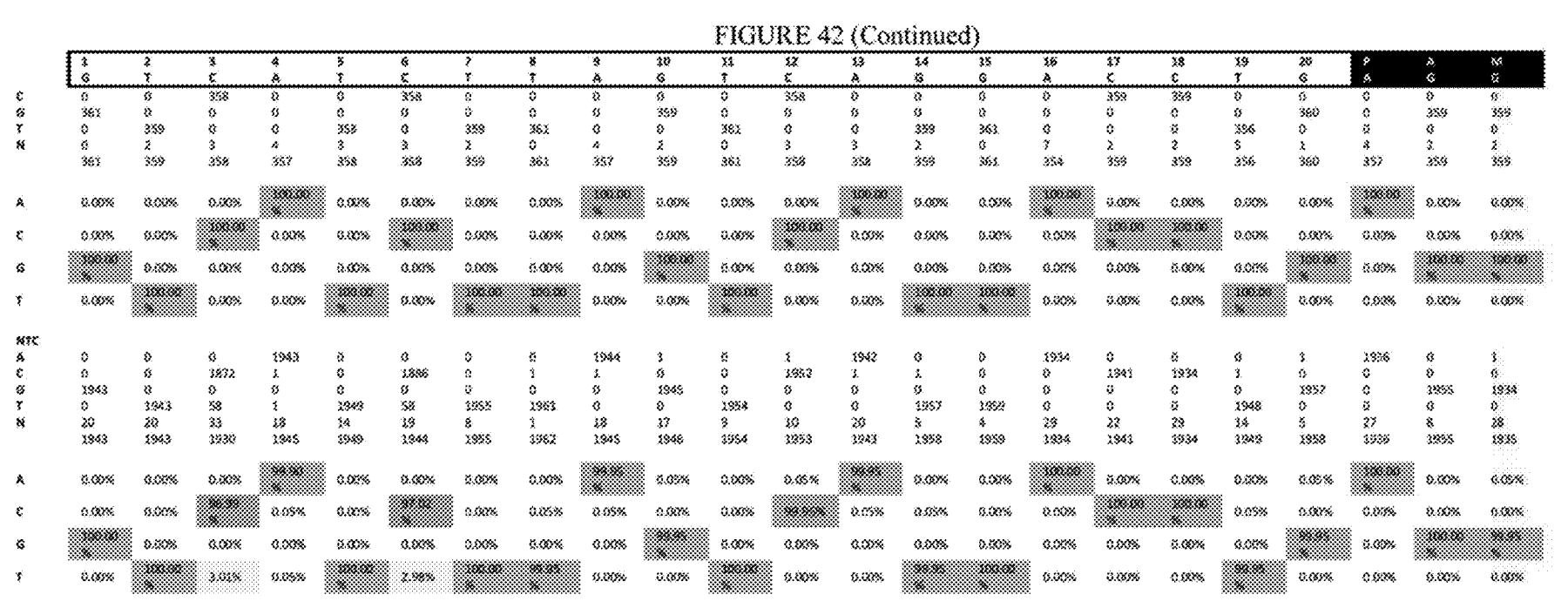

FIG. 42 shows the results of transfection at the RNF-2 site. The sequence corresponds to SEQ ID NO: 44.

Figure 43:
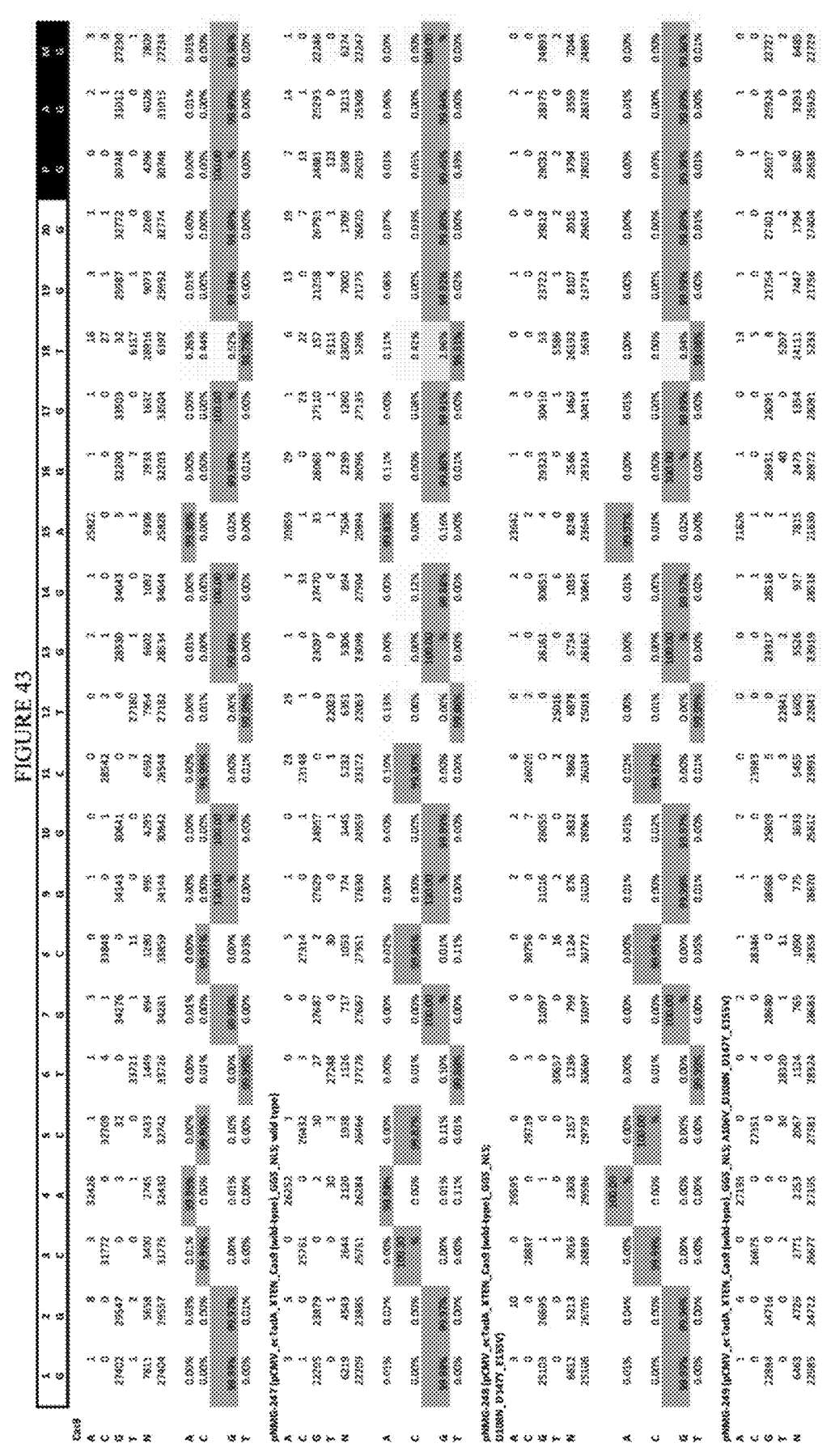
Figure 43:
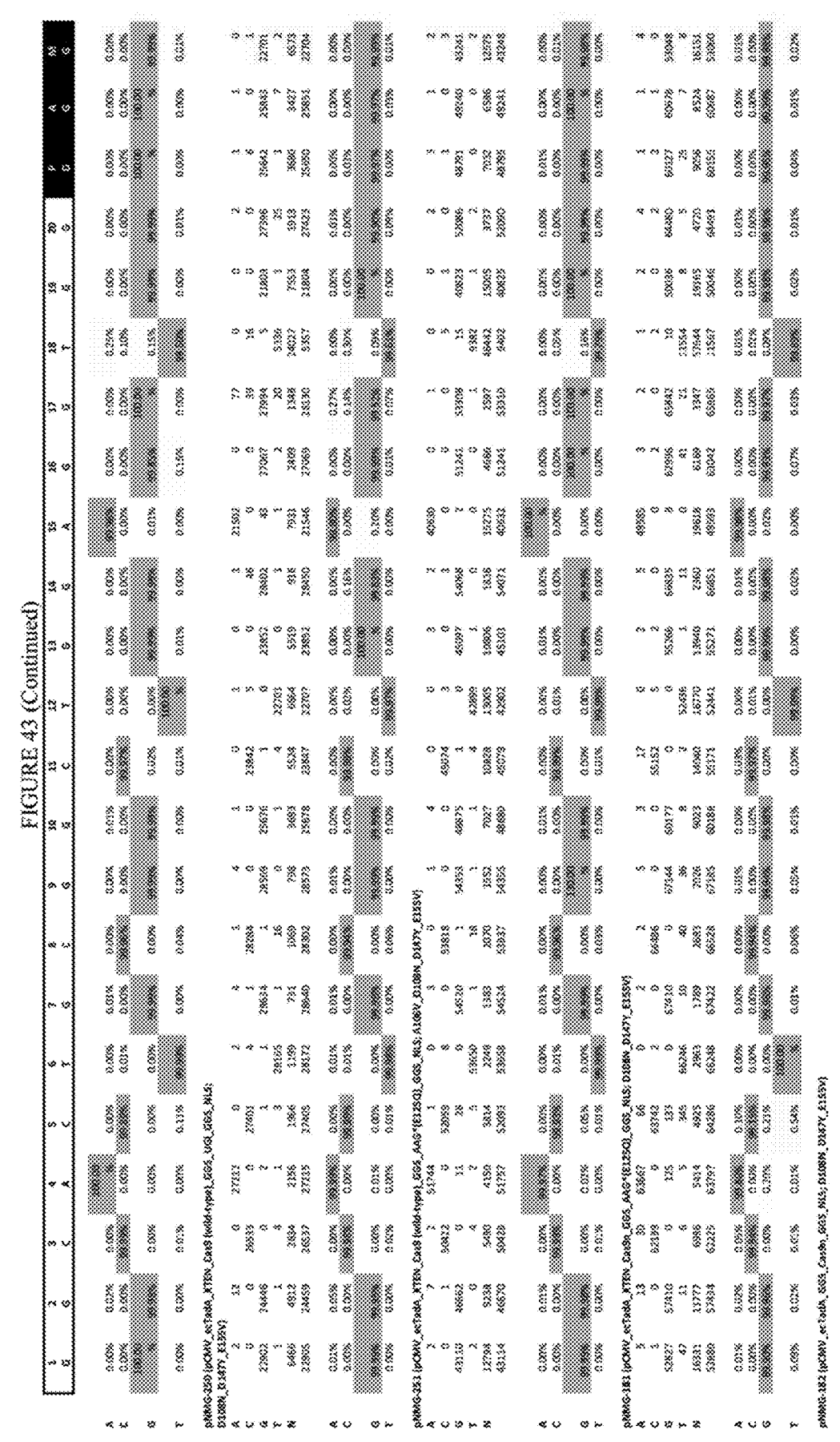
Figure 43:
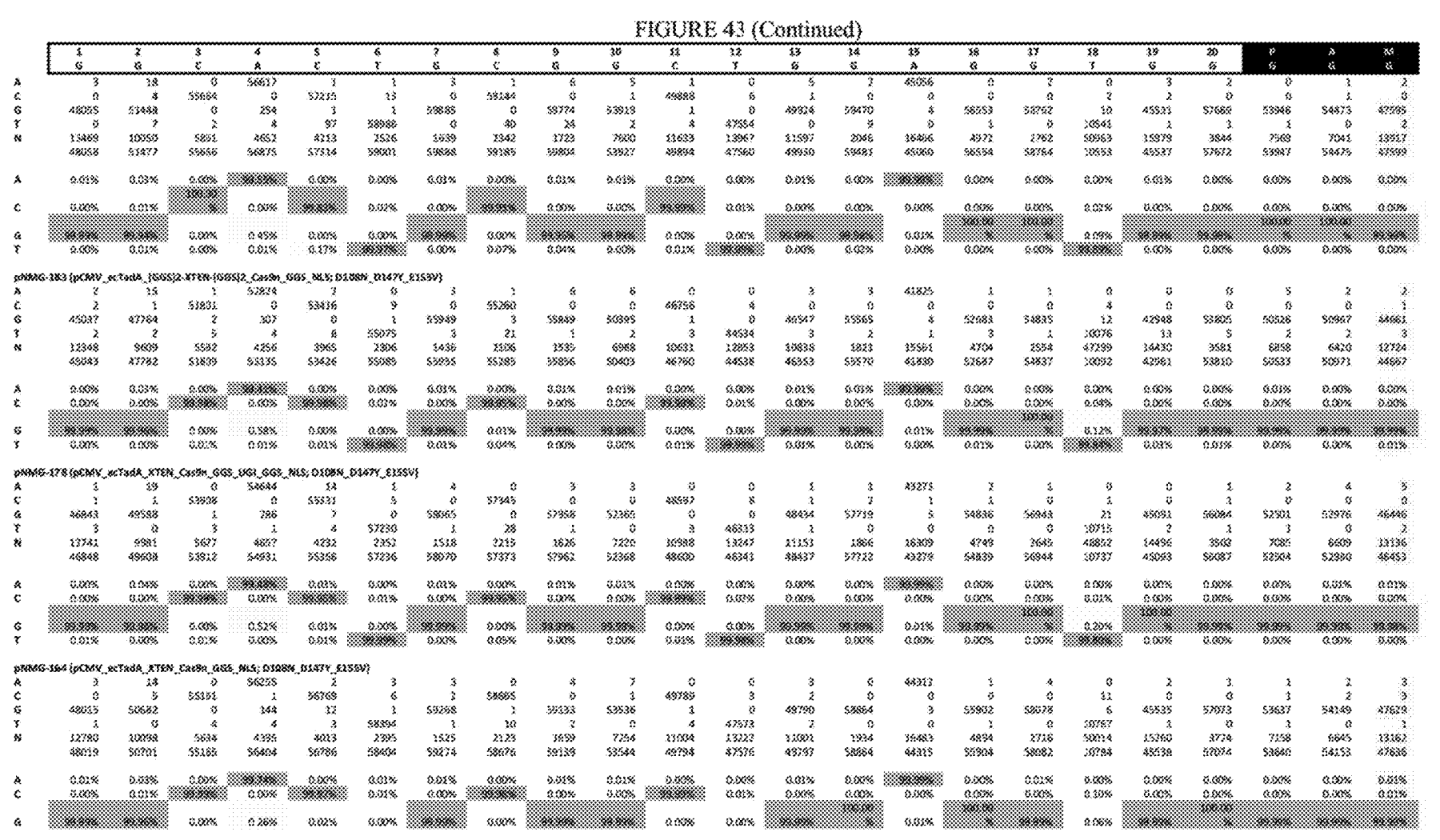
Figure 43:
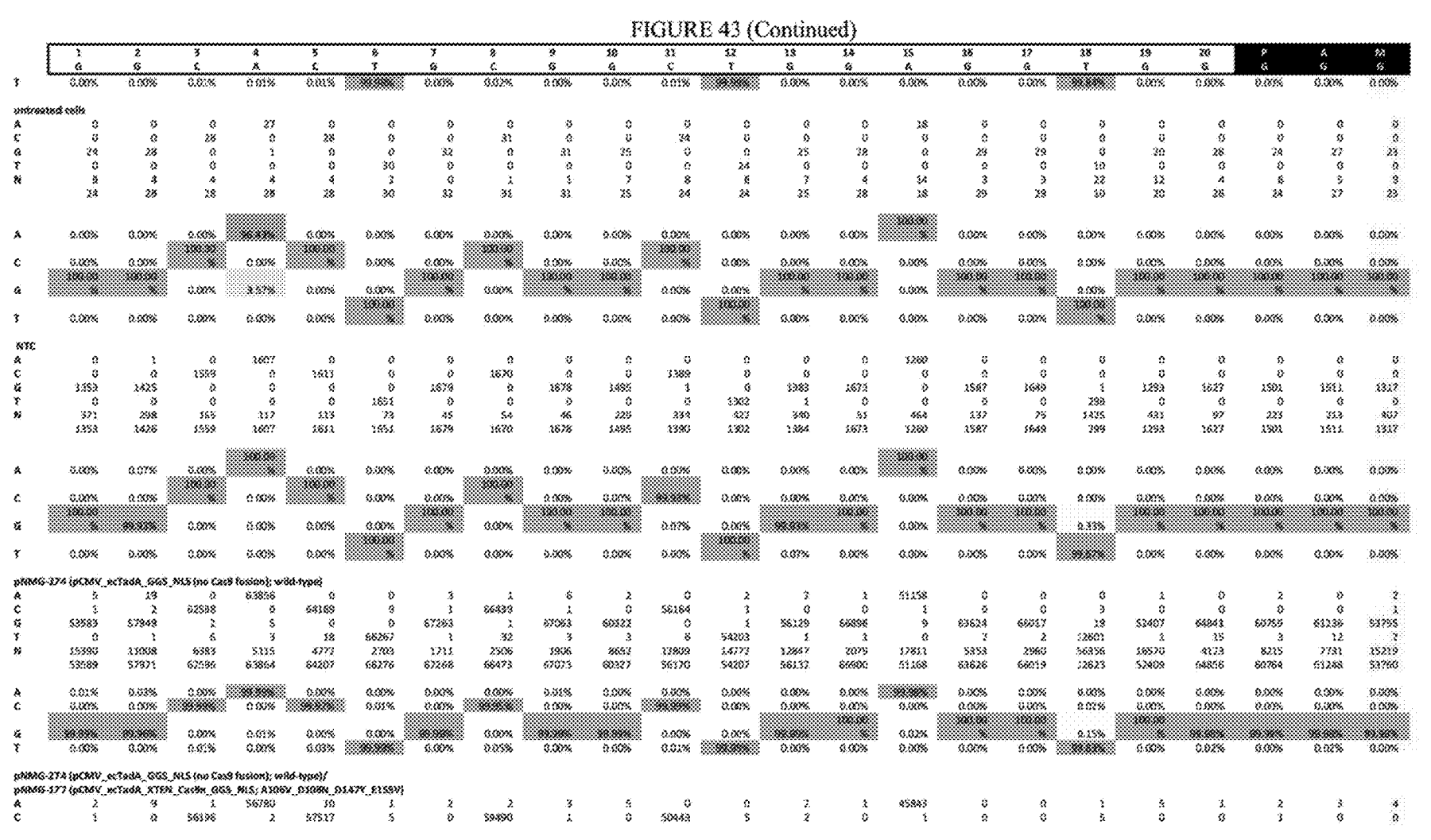
Figure 43:
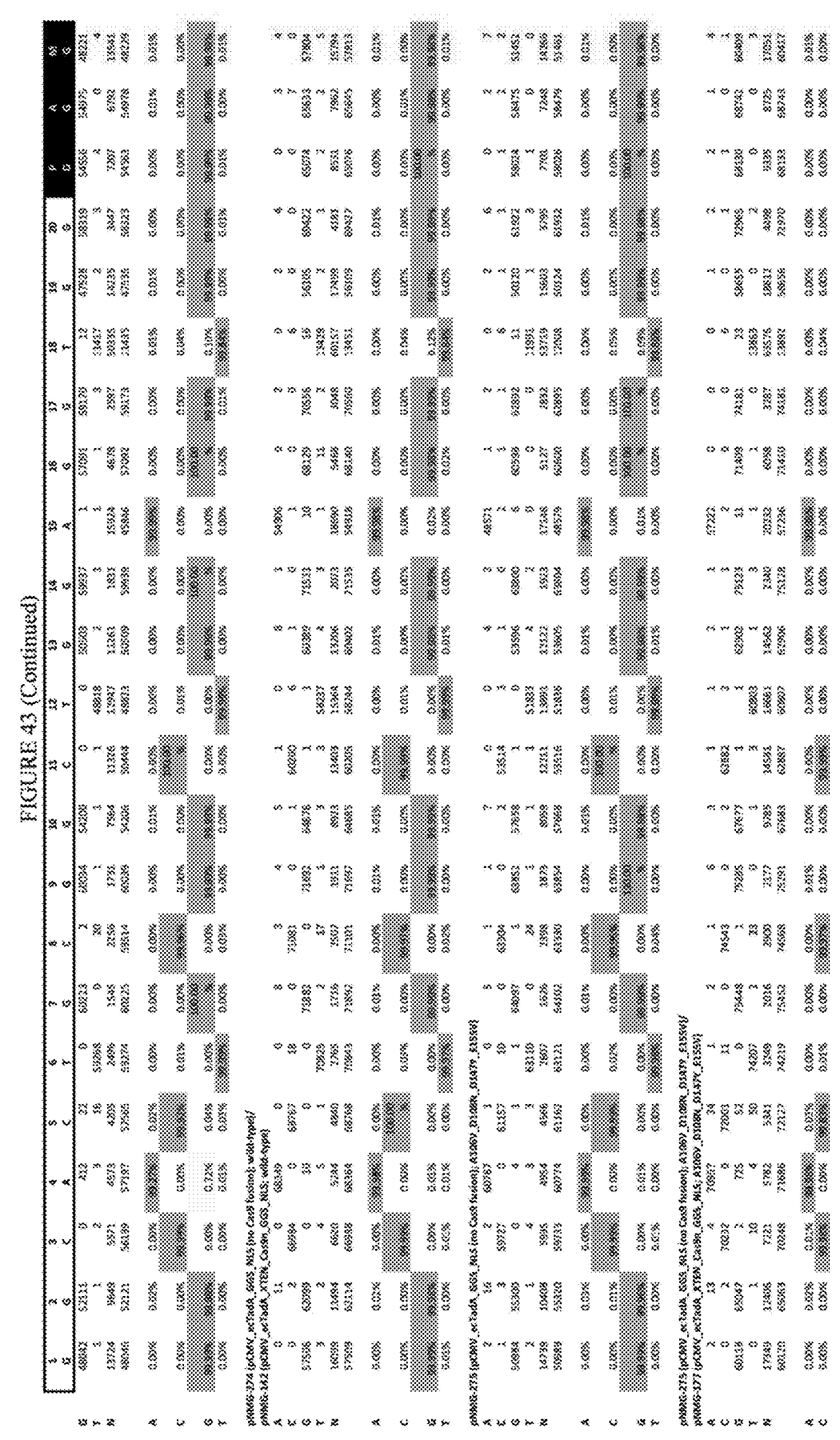
Figure 43:
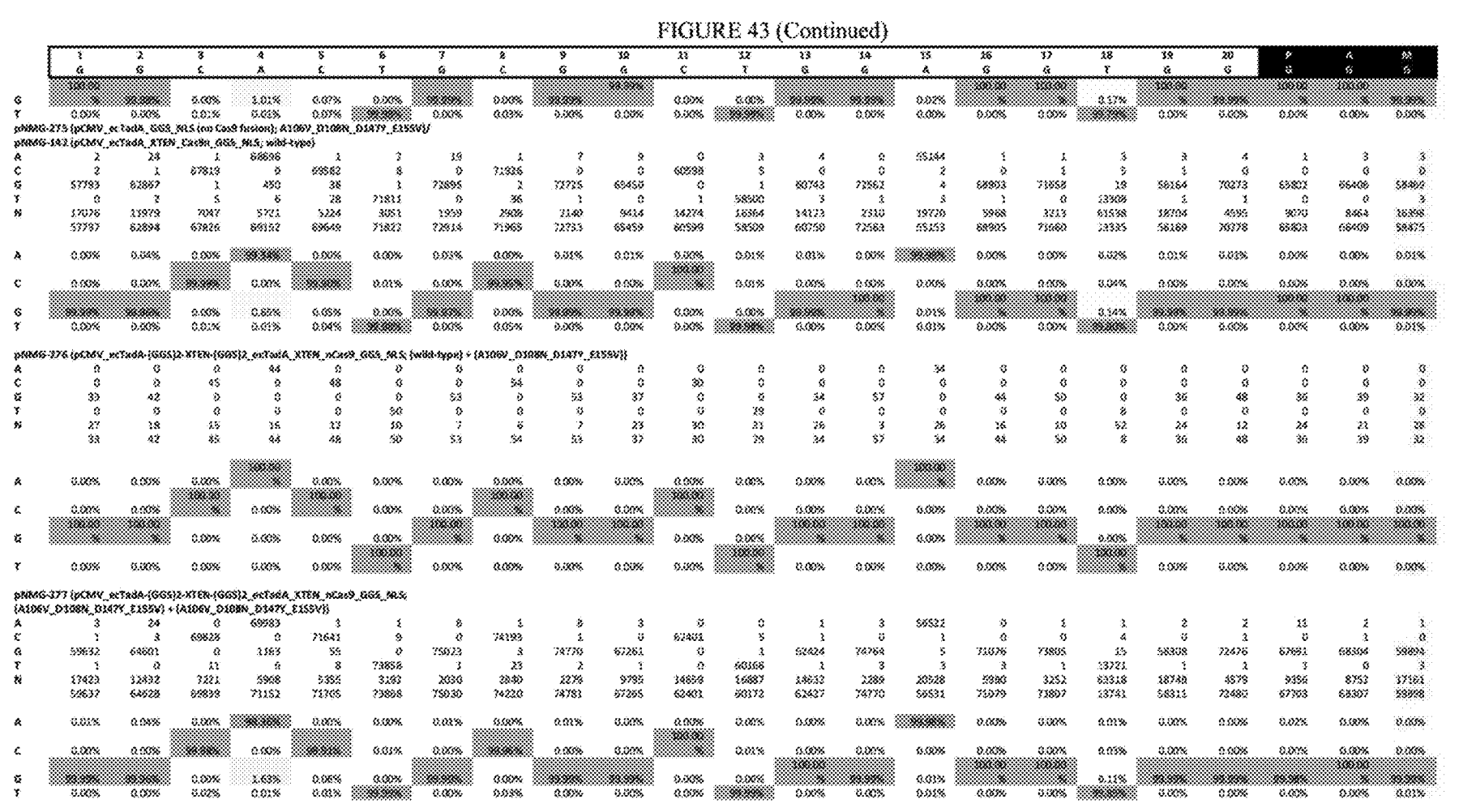

FIG. 43 shows the results of transfection at the Hek-4 site. The sequence corresponds to SEQ ID NO: 43.

Figure 44:
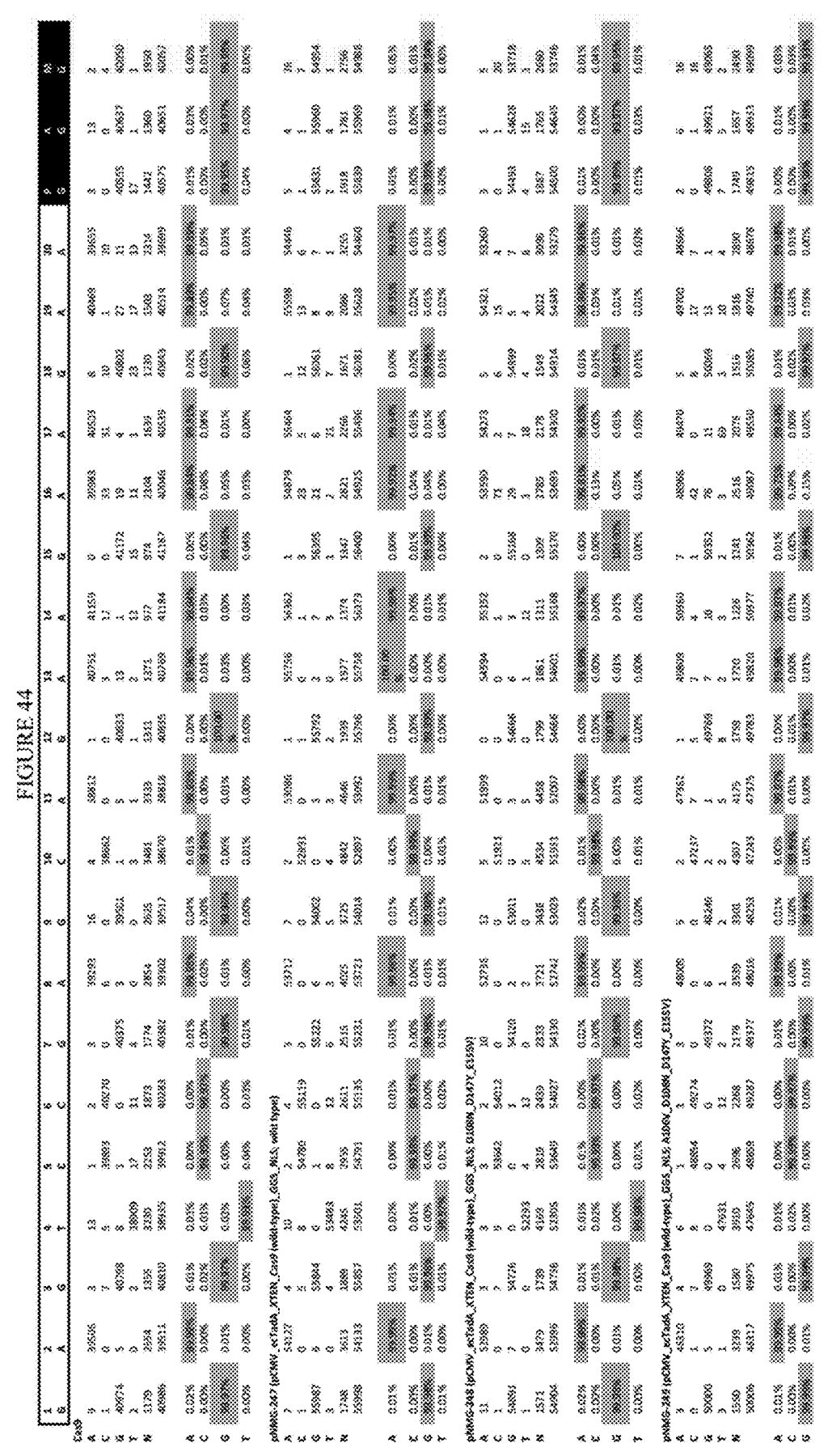
Figure 44:
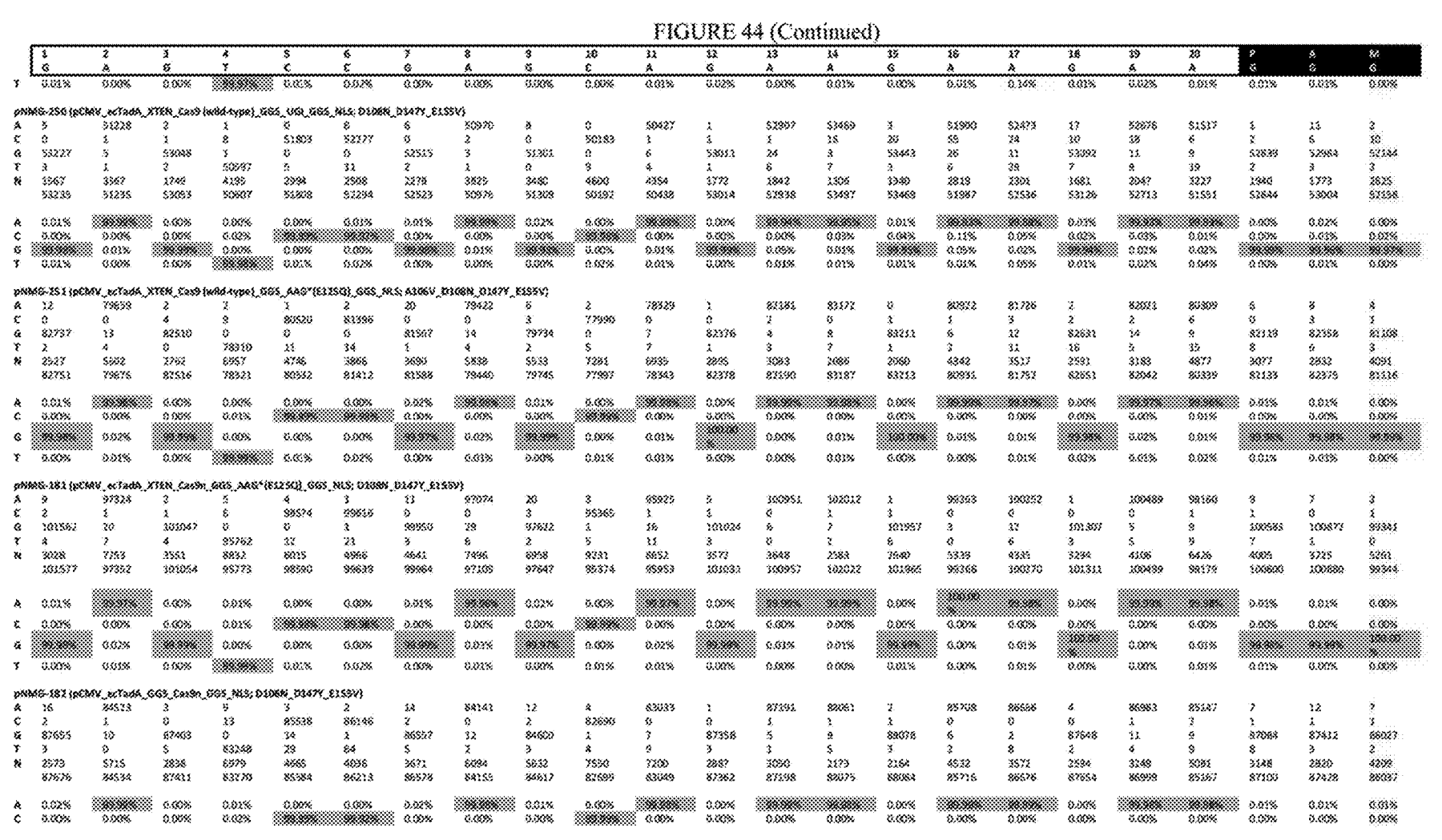
Figure 44:
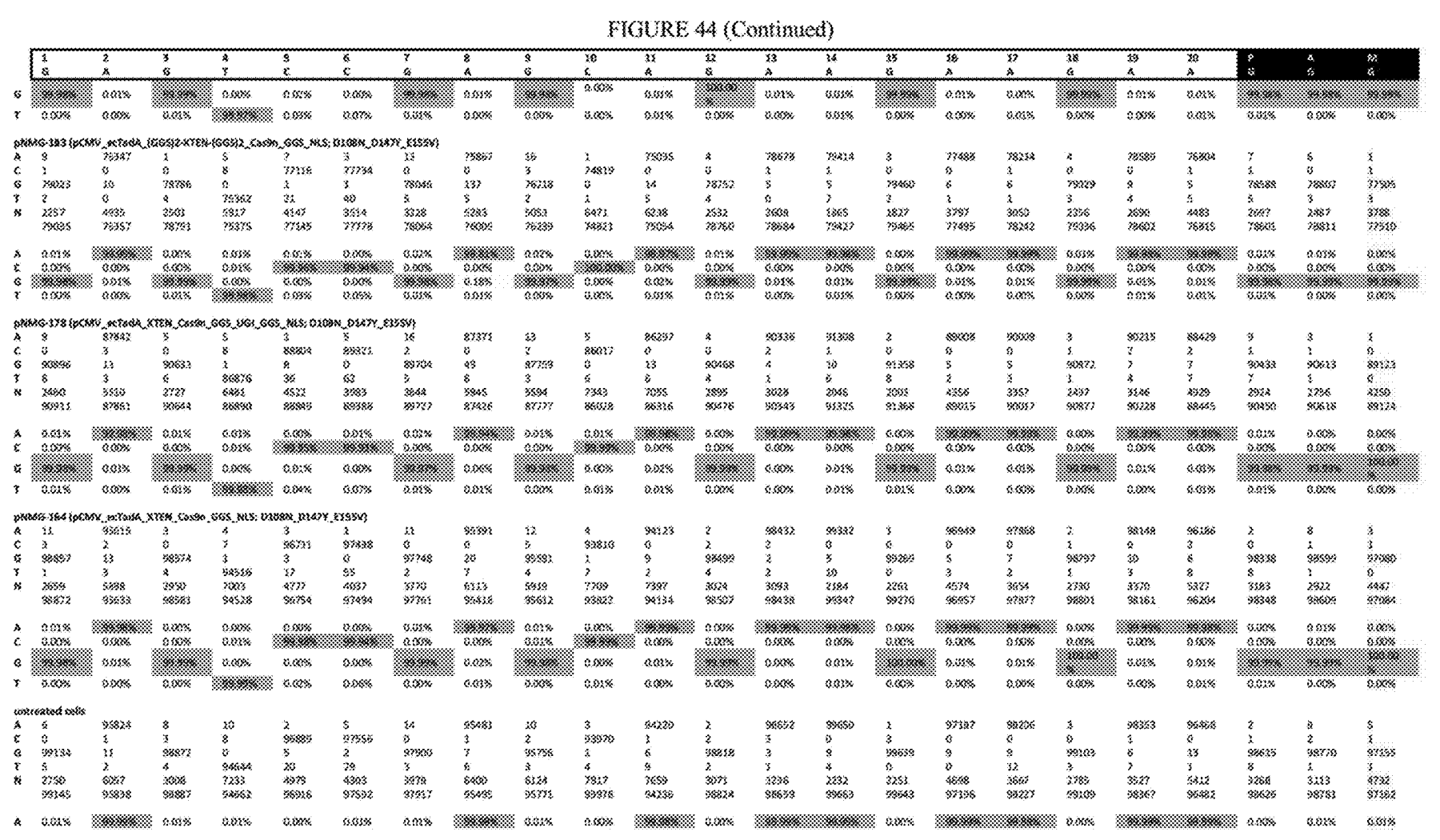
Figure 44:
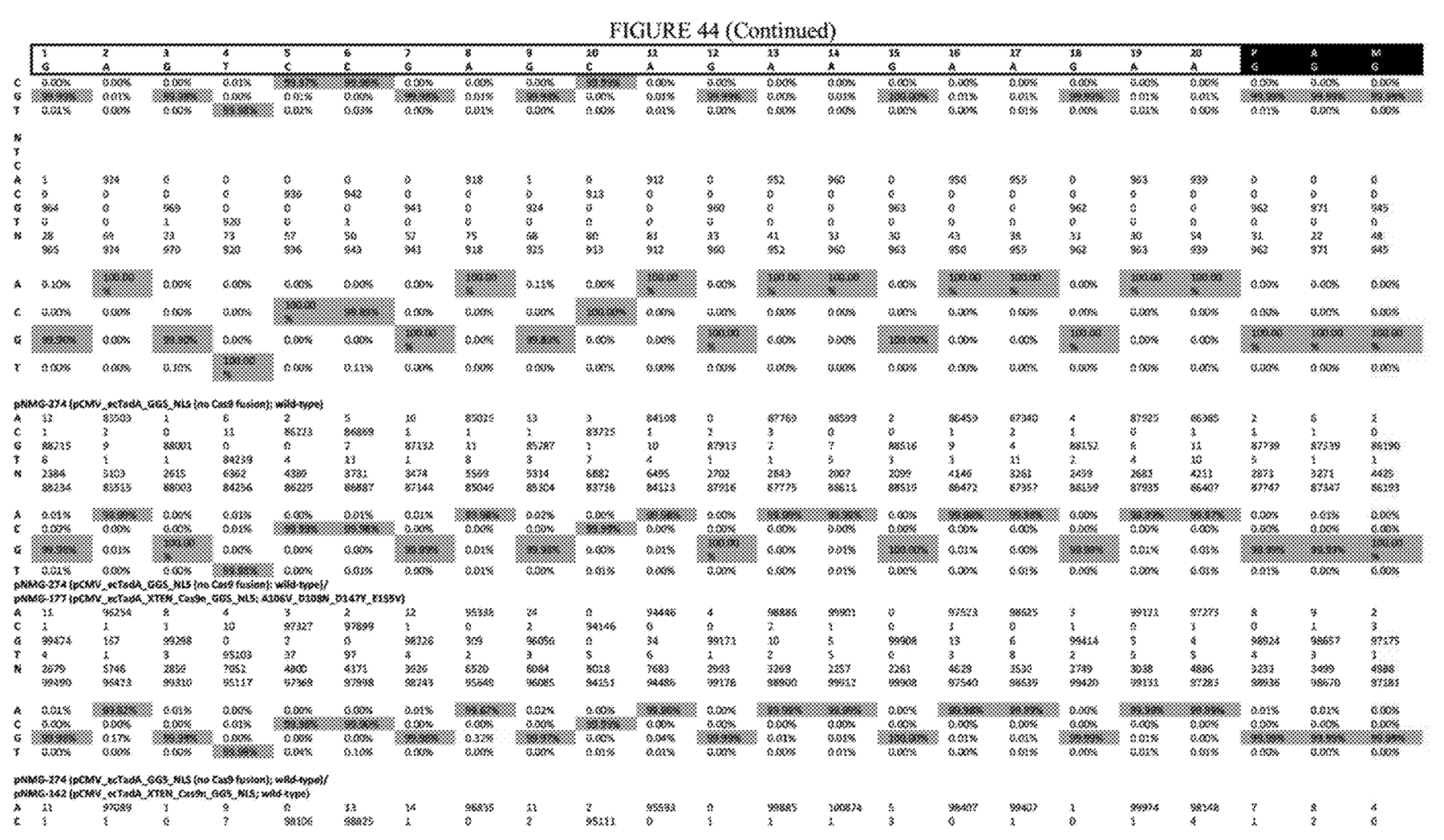
Figure 44:
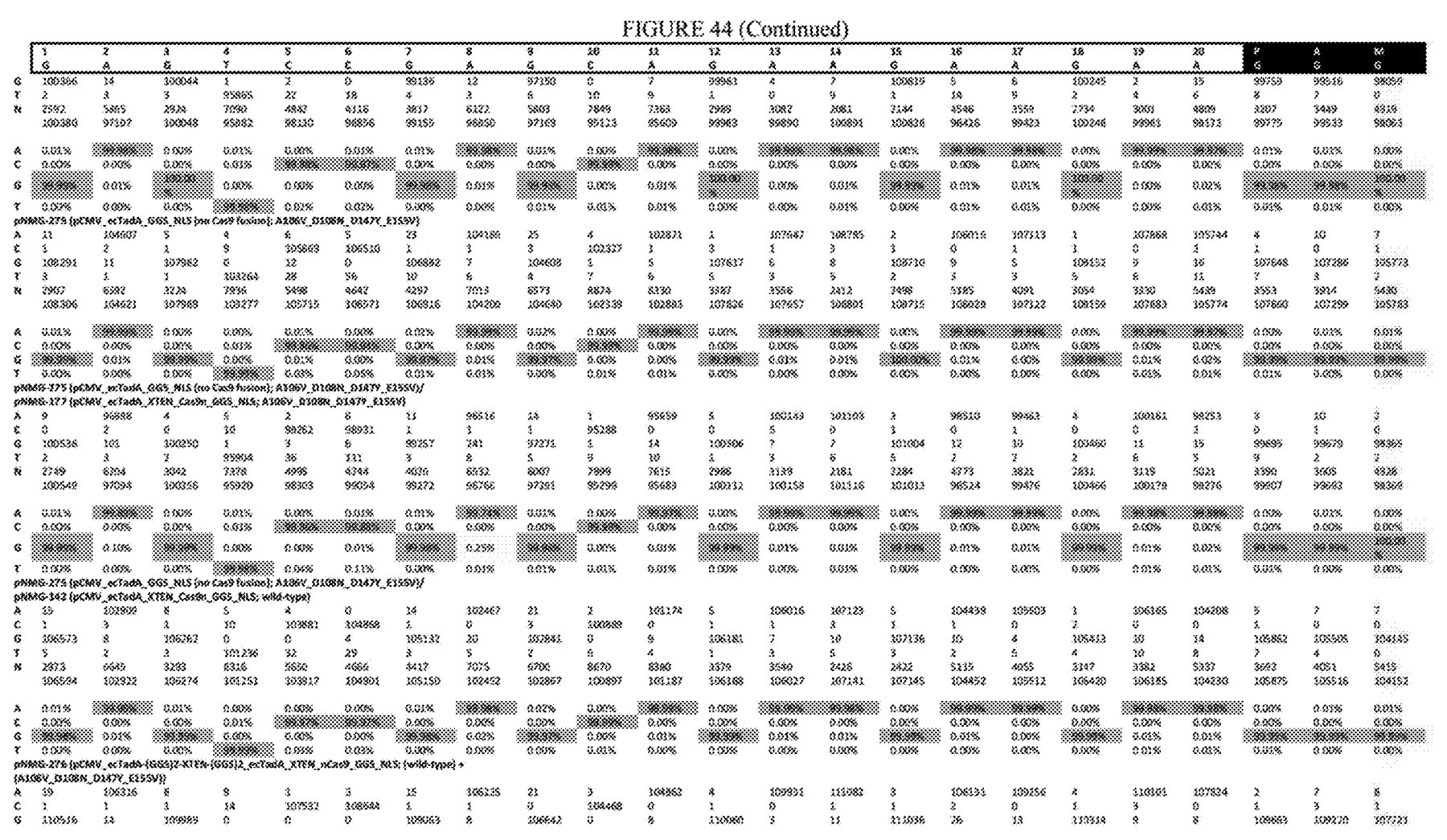
Figure 44:
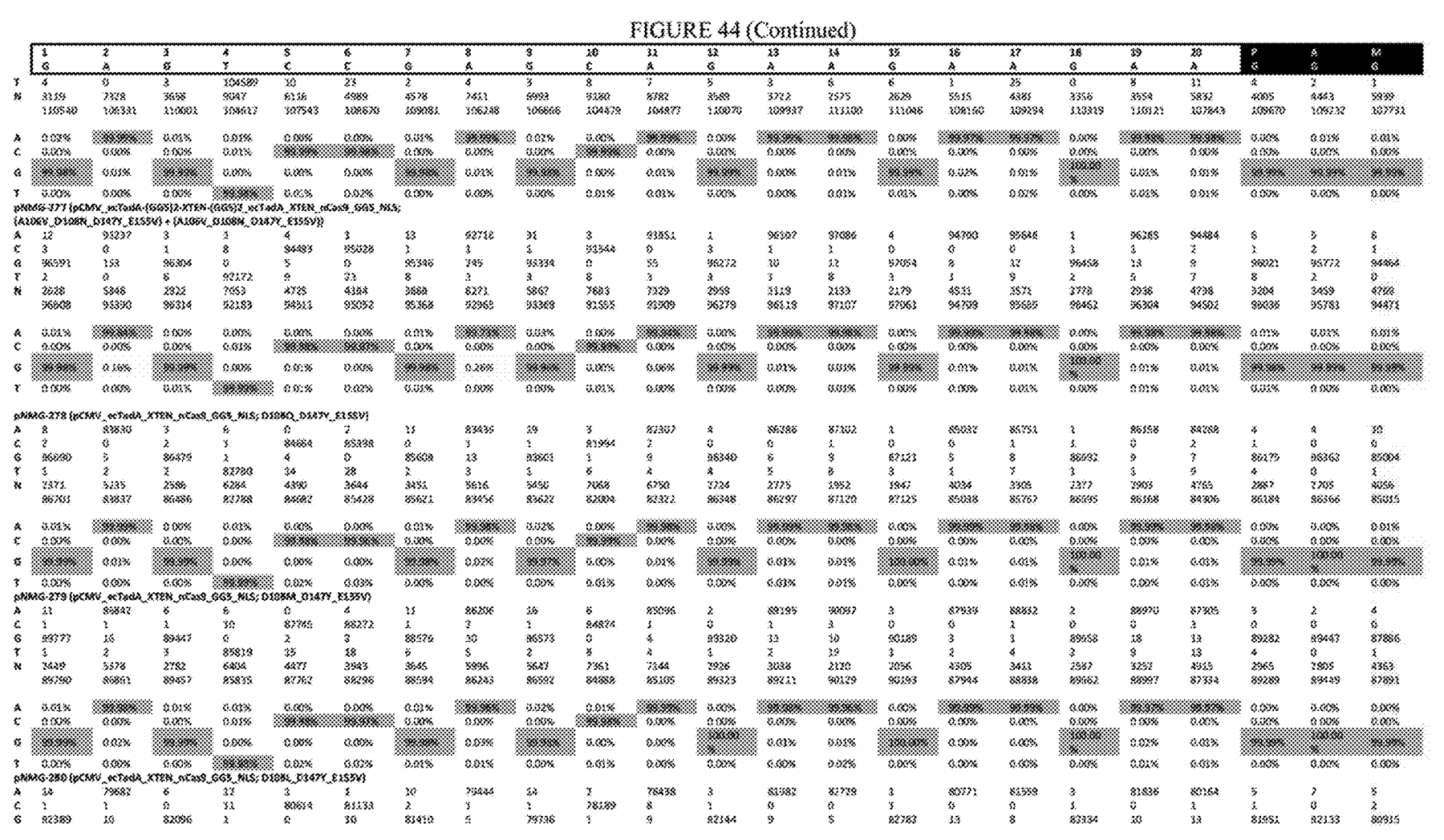
Figure 44:
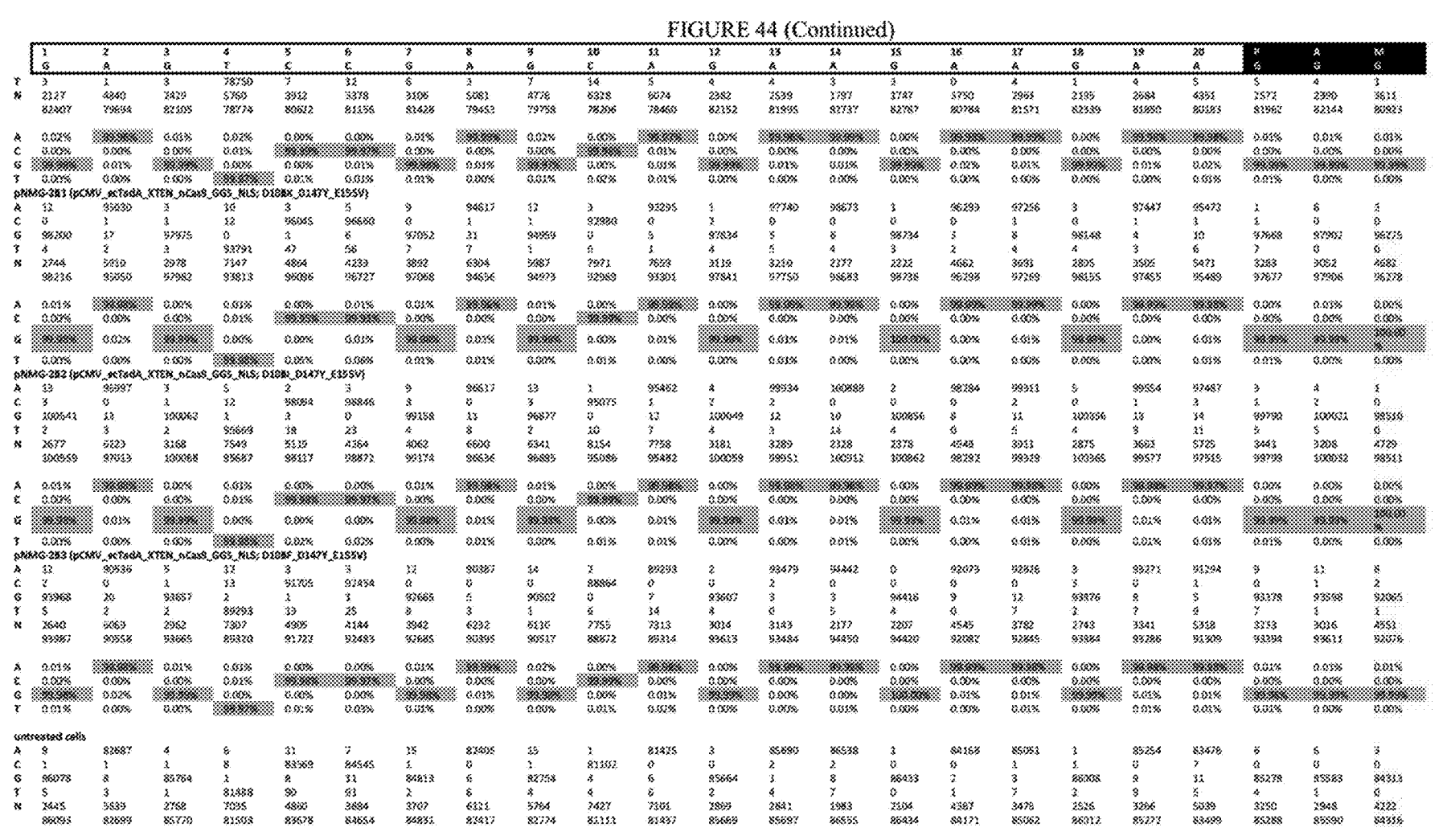
Figure 44:
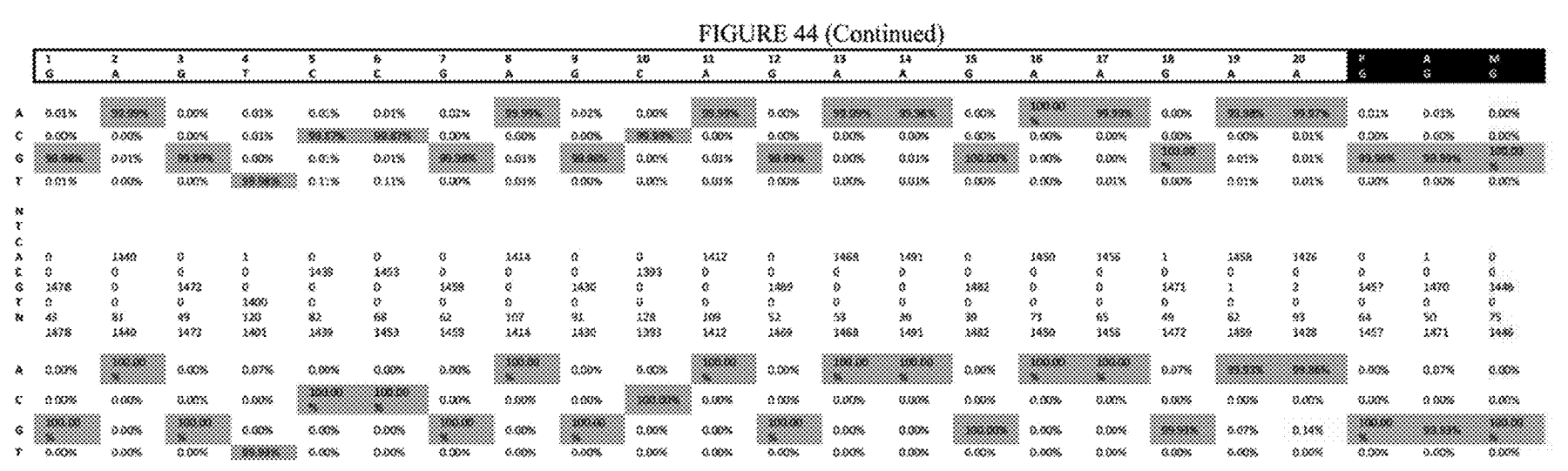

FIG. 44 shows the results of transfection at the EMX-1 site. The sequence corresponds to SEQ ID NO: 46.

Figure 45:
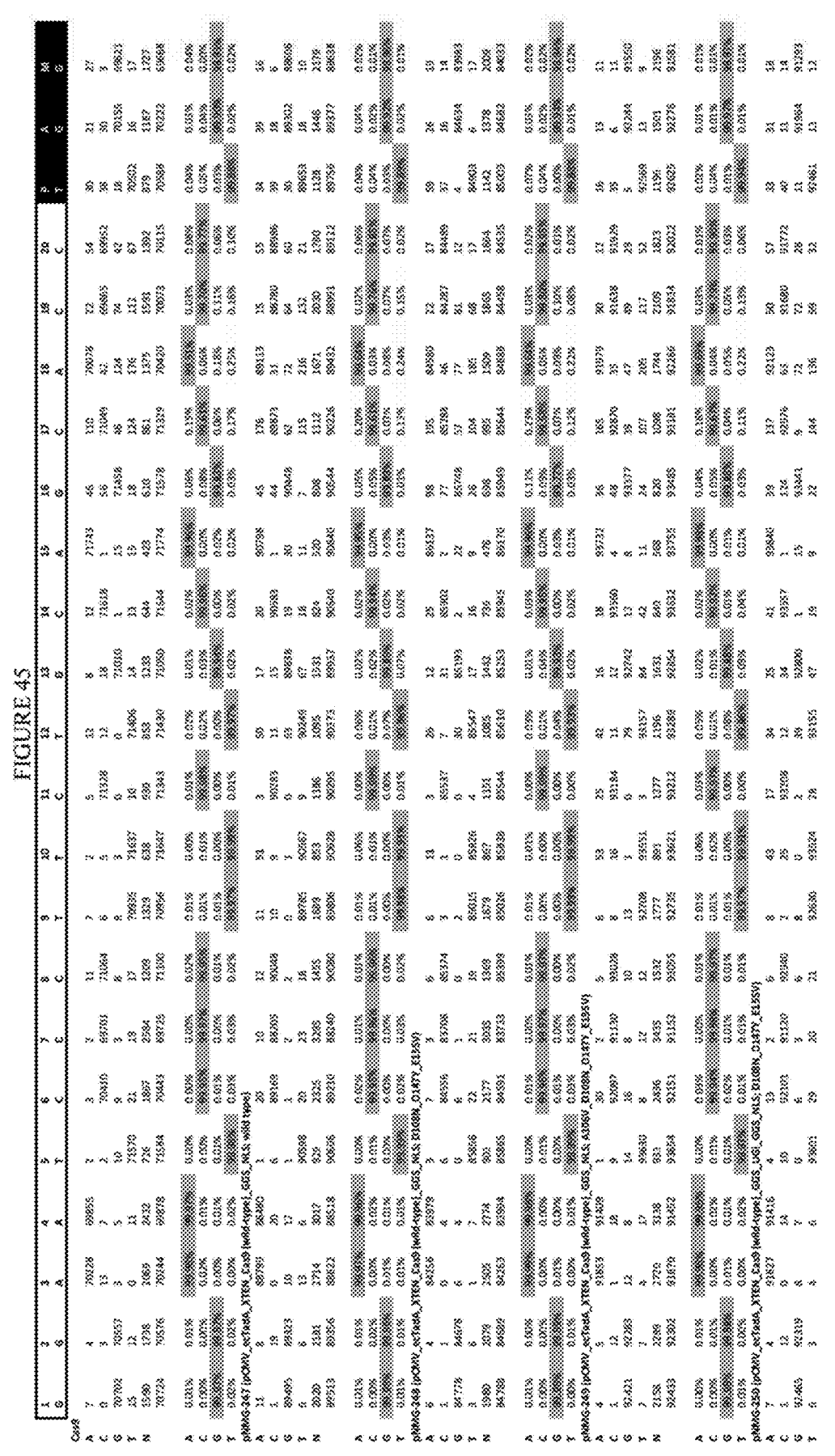
Figure 45:
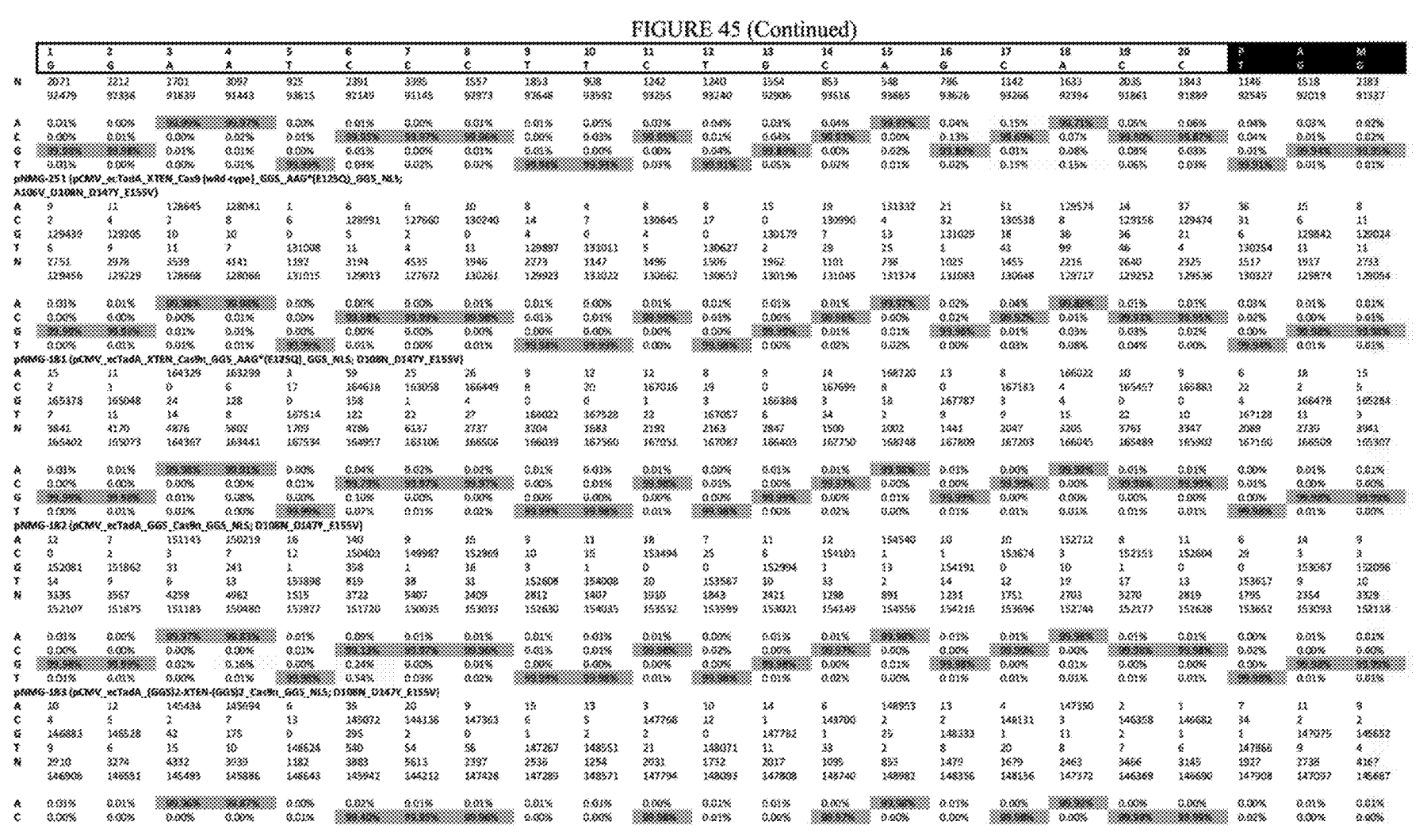
Figure 45:
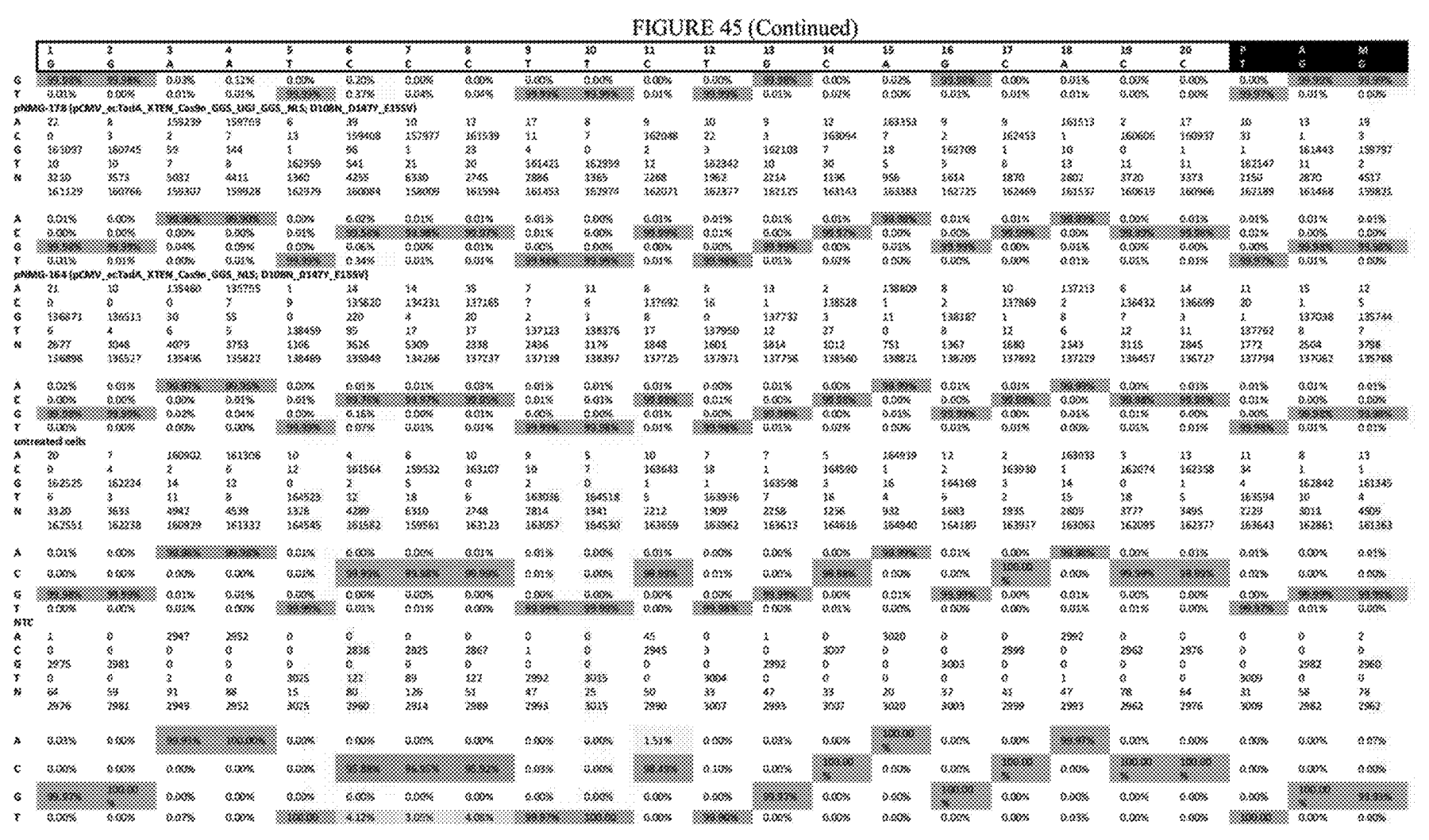
Figure 45:
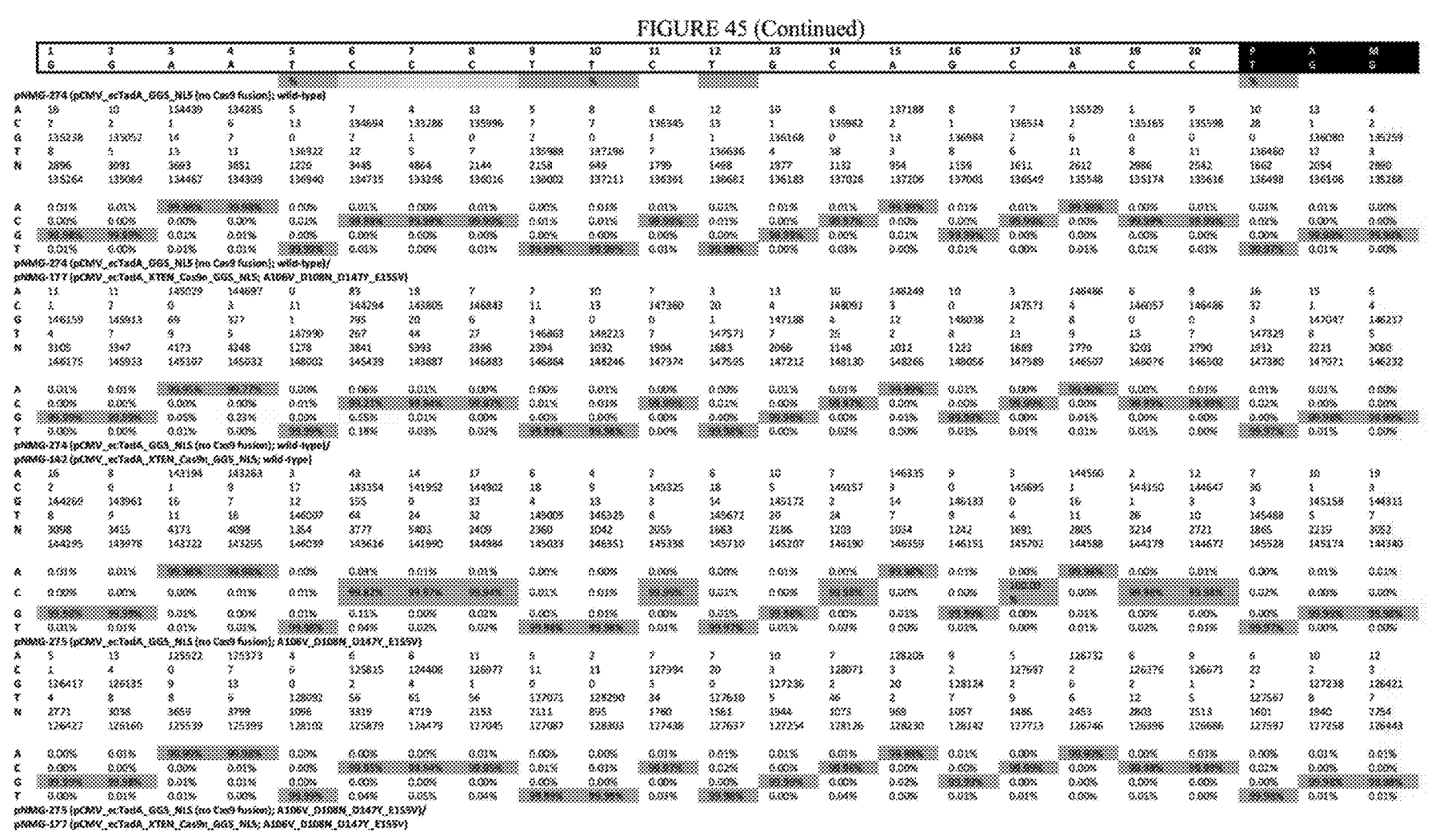
Figure 45:
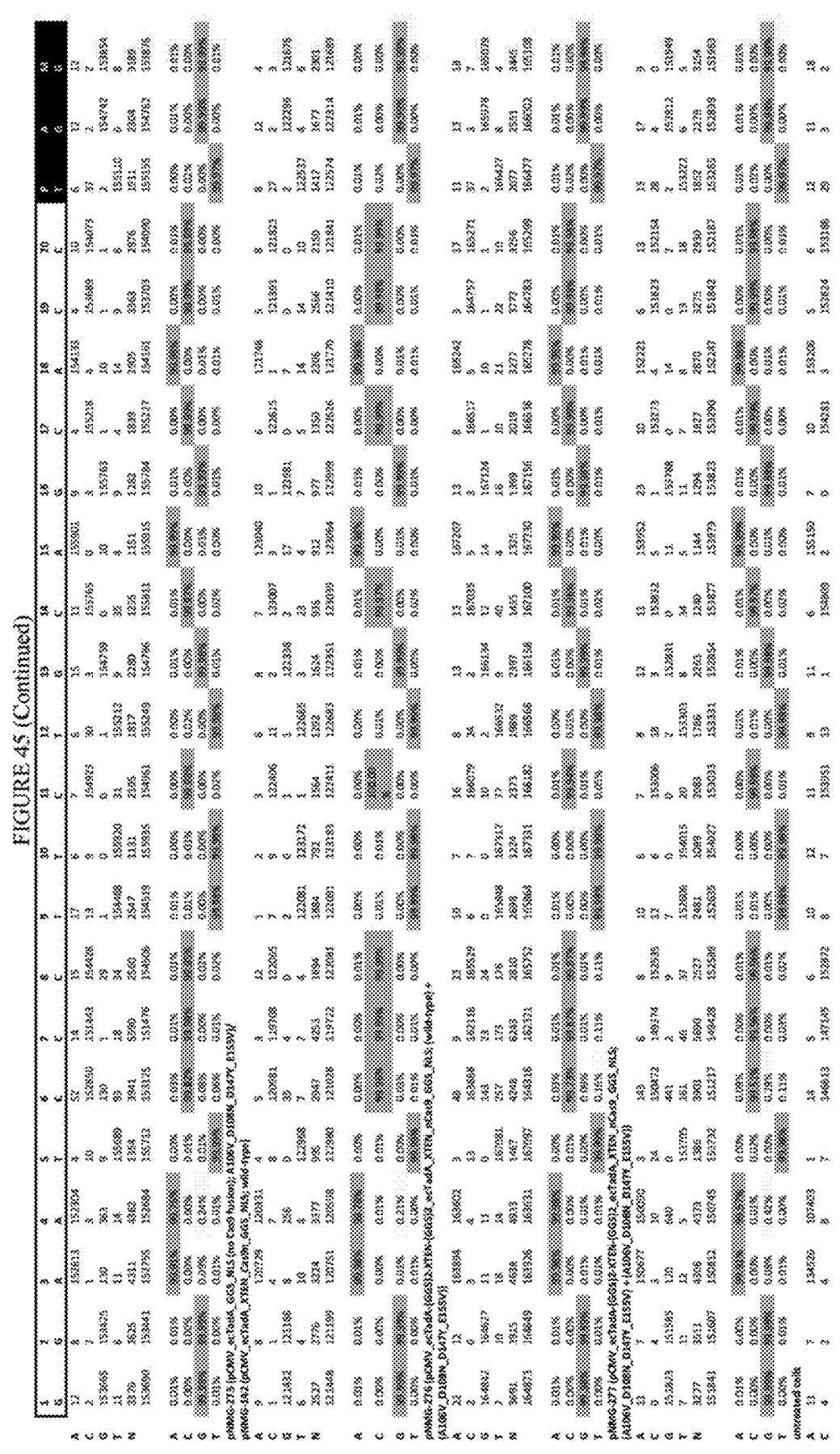
Figure 45:
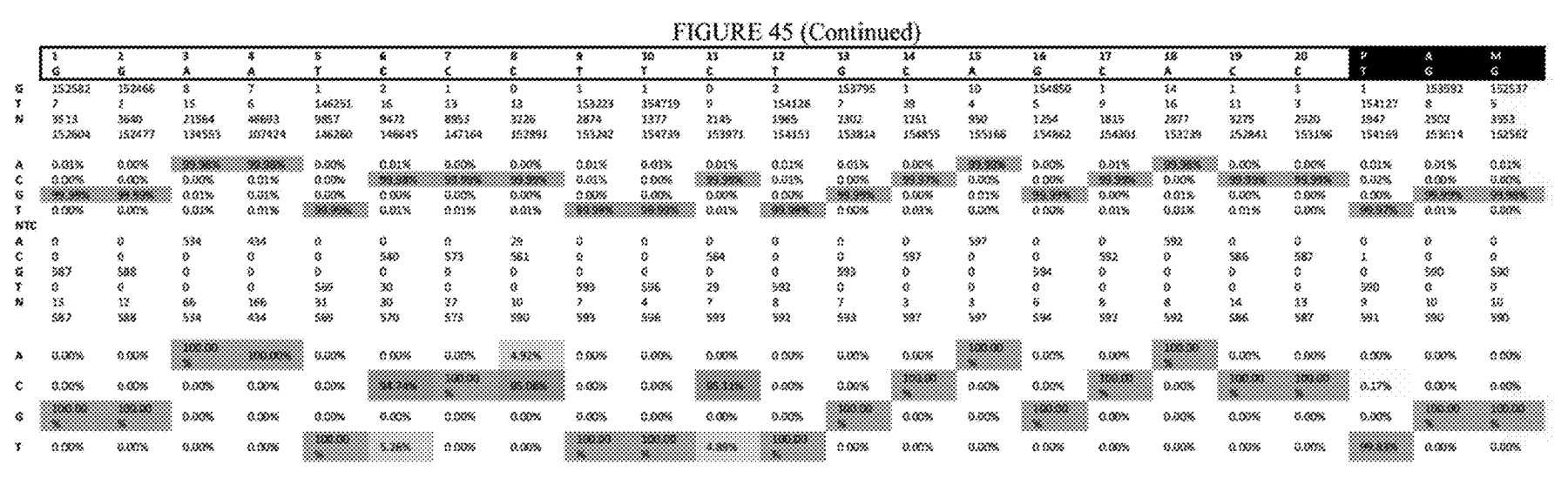

FIG. 45 shows the results of transfection at the FANCF site. The sequence corresponds to SEQ ID NO: 45.

FIG. 46 shows deaminase editing of sgRNA.

FIG. 47 shows constructs developed for fusions at various sites.

FIG. 48 shows indel rates for different fusions at various sites.

FIG. 49 shows the protospacer and PAM sequences of base editing sites set forth in SEQ ID NOs: 46, 45, 6, 42, 43, and 468 from top to bottom, respectively.

FIG. 59 shows the importance of linker length on base editing function.

FIG. 60 shows the importance of linker length on base editing function.

FIG. 64 shows dimerization results from base editing.

FIG. 65 shows dimerization results from base editing.

FIG. 69 shows the current editor targeting Q4 stop site. The sequences from top to bottom and left to right correspond to SEQ ID NOs: 624-627, 5527, and 628.

FIG. 70 shows the current editor targeting W15 stop site. The sequences correspond to SEQ ID NOs: 629-632, 5528, and 633 from top to bottom and left to right, respectively.

FIG. 71 shows a HEK293 site 2 sequence. The sequence corresponds to SEQ ID NO: 360.

FIG. 72 shows the results of the first run with various edTadA mutations using the sequence of FIG. 71.

Figure 73:
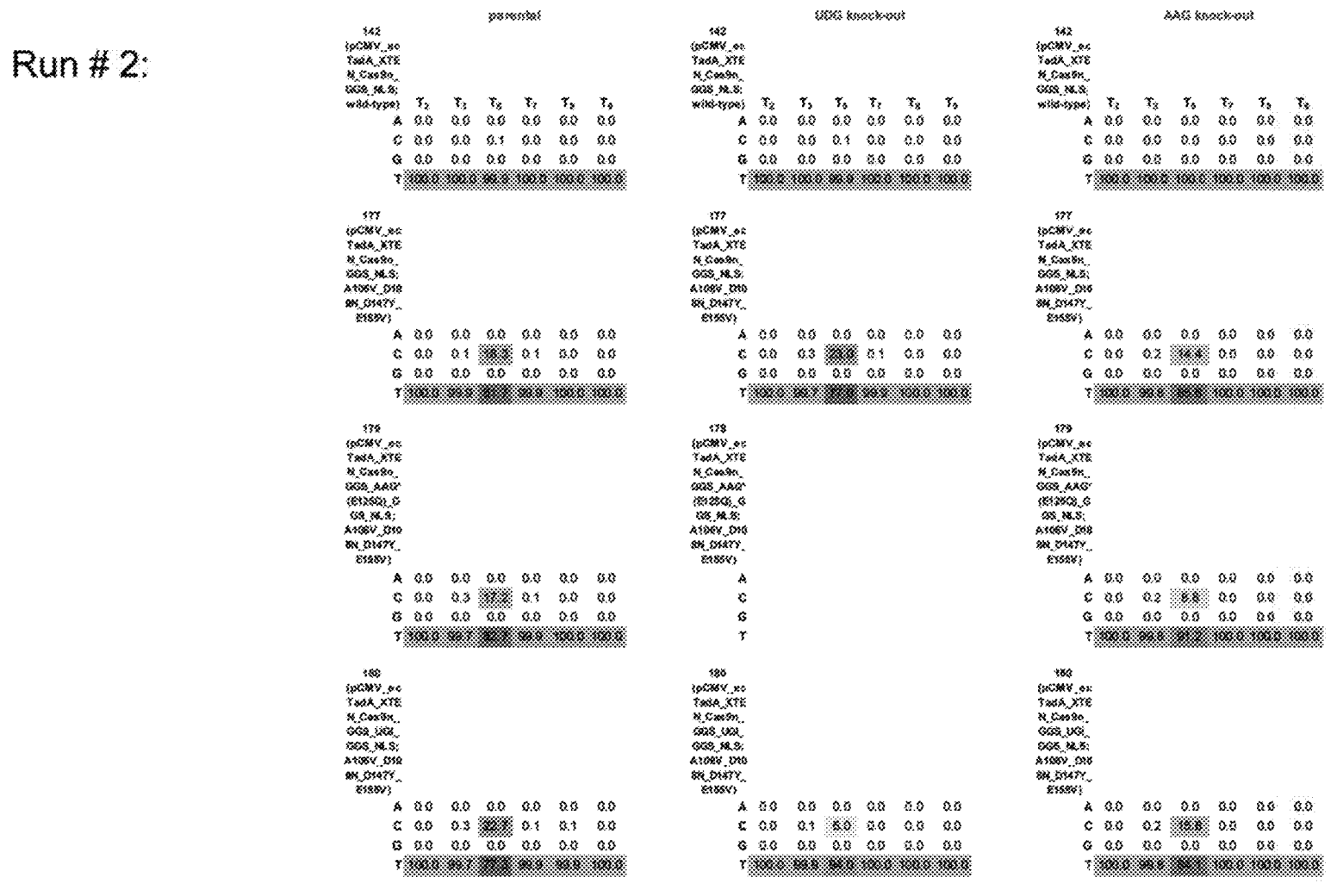

FIG. 73 shows the results of the second run with various edTadA mutations using the sequence of FIG. 71.

FIG. 74 shows a FANCF sequence. The sequence corresponds to SEQ ID NO: 45.

FIG. 75 shows the results of the second run using various edTadA mutations and the sequence of FIG. 74.

Figure 76:
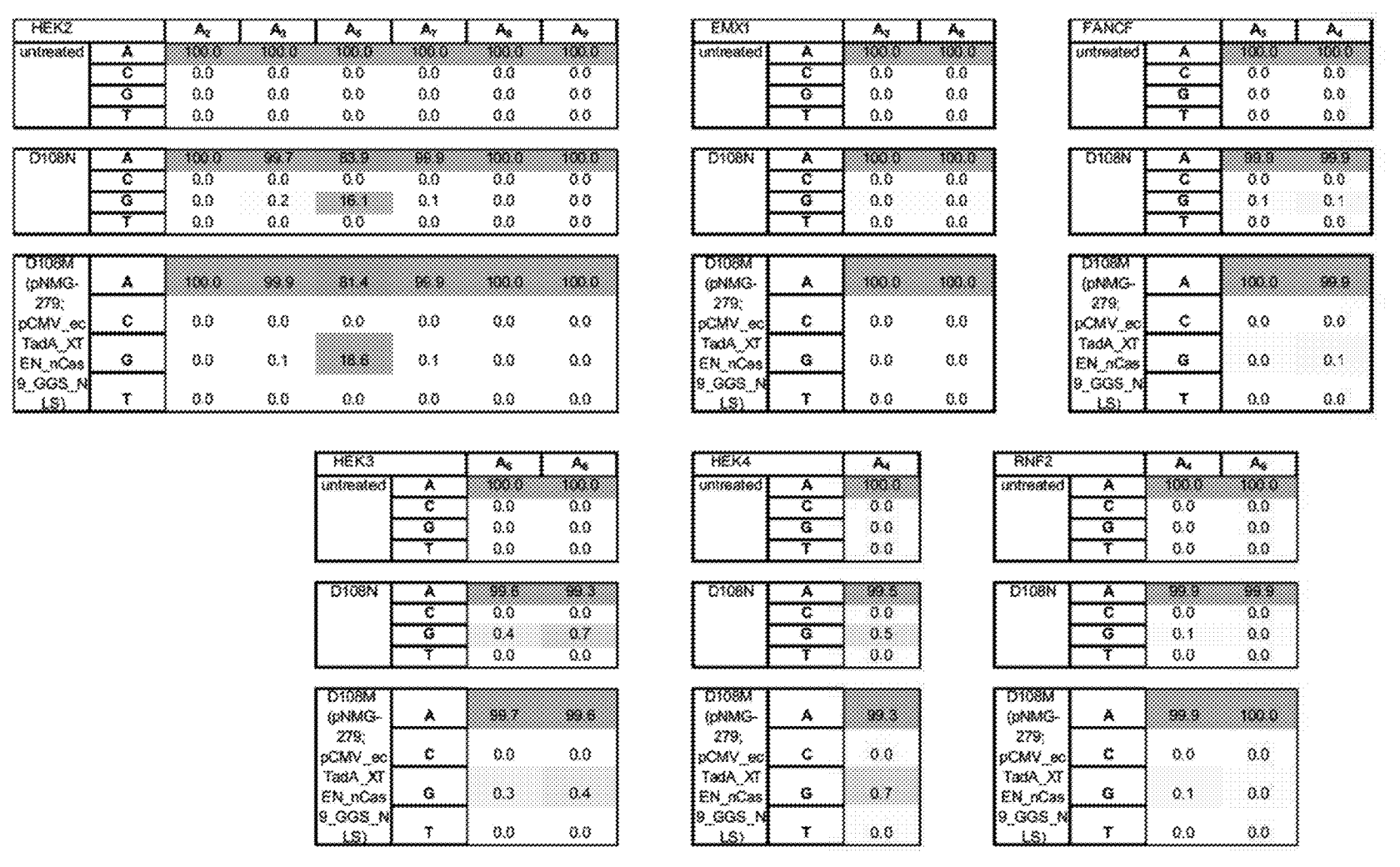

FIG. 76 shows the results of mutated D108 on all sites.

Figure 77:
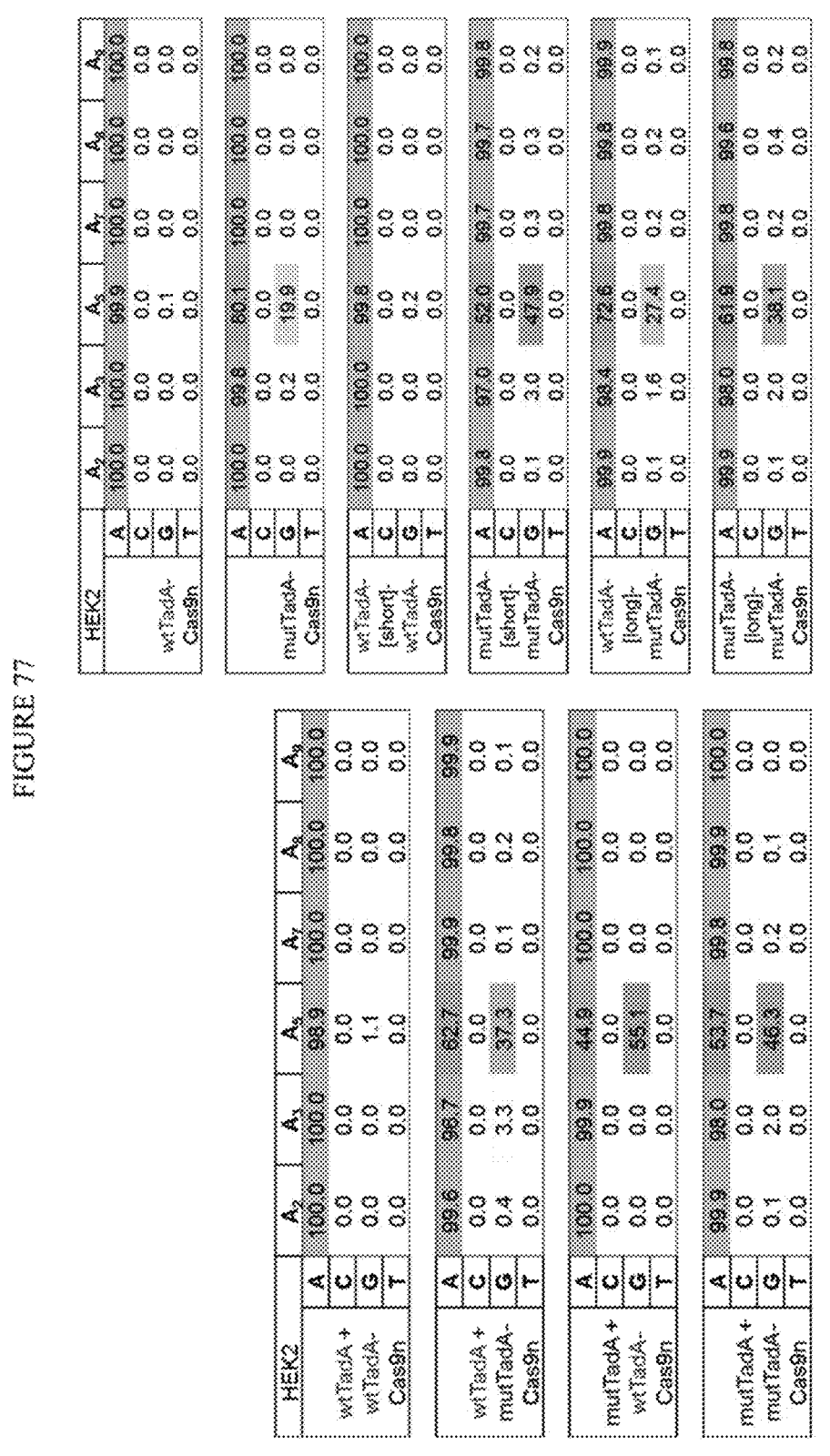

FIG. 77 shows in trans data from previous run (left panel) and the mut-mut fusions hindered by super long linkers.

Figure 78:
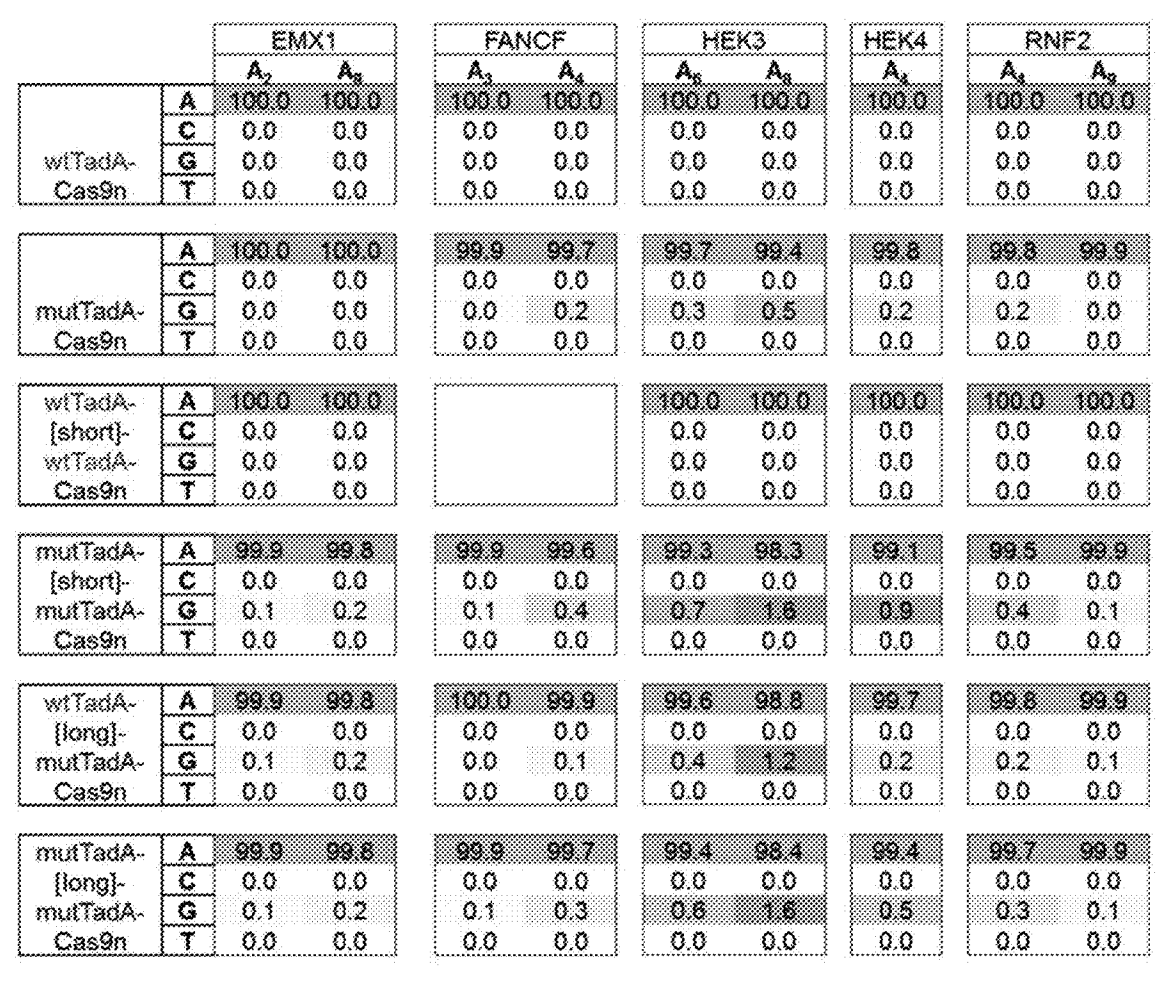

FIG. 78 shows the results of tethering mutTadA to ABE.

FIG. 86 shows the constructs used when tethering EndoV to ABE.

FIG. 87 is a schematic showing the tethering EndoV to ABE.

FIG. 88 shows the results of tethering EndoV to ABE.

FIG. 89 shows the constructs used when tethering UGI to ABE.

FIG. 90 shows the results of tethering UGI to the end of ABE.

FIG. 108 shows a summary of results of editing at the Hek-2 site. The Hek-2 sequence provided in the figure represents the reverse complement of SEQ ID NO: 41, which is the DNA strand where A to G editing takes place. The sequence corresponds to SEQ ID ID: 6.

FIG. 109 shows a summary of results of editing at the Hek2-3 site. The sequence corresponds to SEQ ID NO: 363.

FIG. 110 shows a summary of results of editing at the Hek2-6 site. The sequence corresponds to SEQ ID NO: 364.

FIG. 111 shows a summary of results of editing at the Hek2-7 site. The Hek2-7 sequence provided in the figure represents the reverse complement of the DNA strand where A to G editing takes place. The sequence corresponds to SEQ ID NO: 365.

FIG. 112 shows a summary of results of editing at the Hek2-10 site. The sequence corresponds to SEQ ID NO: 366.

FIG. 113 shows a summary of results of editing at the Hek-3 site. The sequence corresponds to SEQ ID NO: 42.

Figure 114:
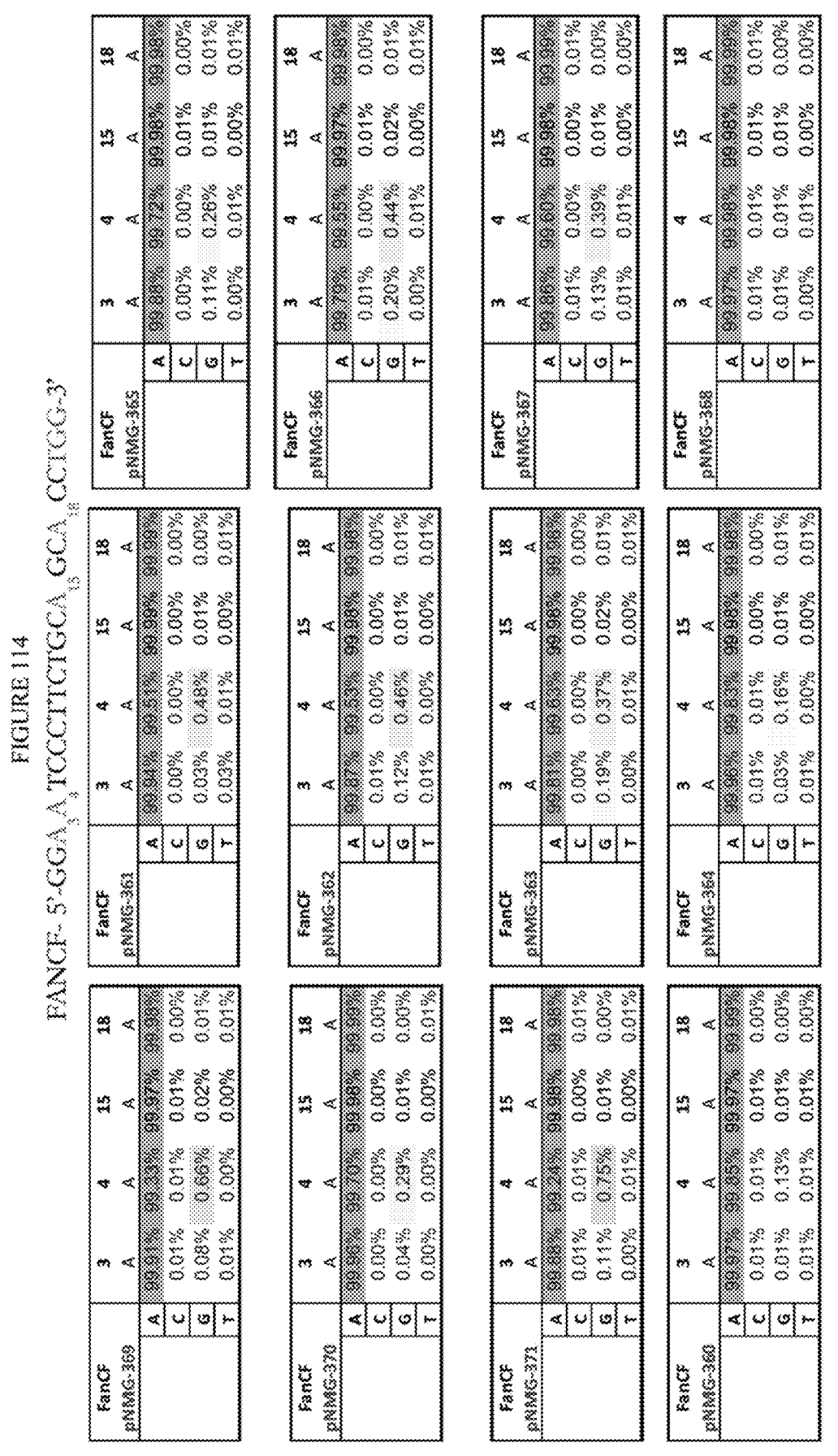

FIG. 114 shows a summary of results of editing at the FANCF site. The sequence corresponds to SEQ ID NO: 45.

FIG. 115 shows a summary of results of editing at the Hek-2 site. The sequence corresponds to SEQ ID NO: 367.

FIG. 116 shows a summary of results of editing at the Hek2-2 site. The sequence corresponds to SEQ ID NO: 368.

FIG. 117 shows a summary of results of editing at the Hek2-3 site. The sequence corresponds to SEQ ID NO: 363.

FIG. 118 shows a summary of results of editing at the Hek2-6 site. The sequence corresponds to SEQ ID NO: 364.

FIG. 119 shows a summary of results of editing at the Hek2-7 site. The sequence corresponds to SEQ ID NO: 365.

FIG. 120 shows a summary of results of editing at the Hek2-10 site. The sequence corresponds to SEQ ID NO: 366.

FIG. 121 shows a summary of results of editing at the Hek-3 site. The sequence corresponds to SEQ ID NO: 42.

FIG. 122 shows a summary of results of editing at the FANCF site. The sequence corresponds to SEQ ID NO: 45.

Figures 123, 124:

FIG. 123 shows the results of ecTadA evolution (evolution #4) at HEK2, HEK2-2, HEK2-3, HEK2-6, HEK2-7, and HEK2-10 sites. The constructs used were pNMG-370 (evolution #2), pNMG-371 (evolution #3), and pNMG 382-389 (evolution #4). The sequences correspond to SEQ ID NOs: 7, 368, 363, 364, 369, and 370 from top to bottom, respectively.

FIG. 124 shows a schematic of a construct containing ecTadA and dCas9 used for ecTadA evolution (evolution #5).

Figure 125:
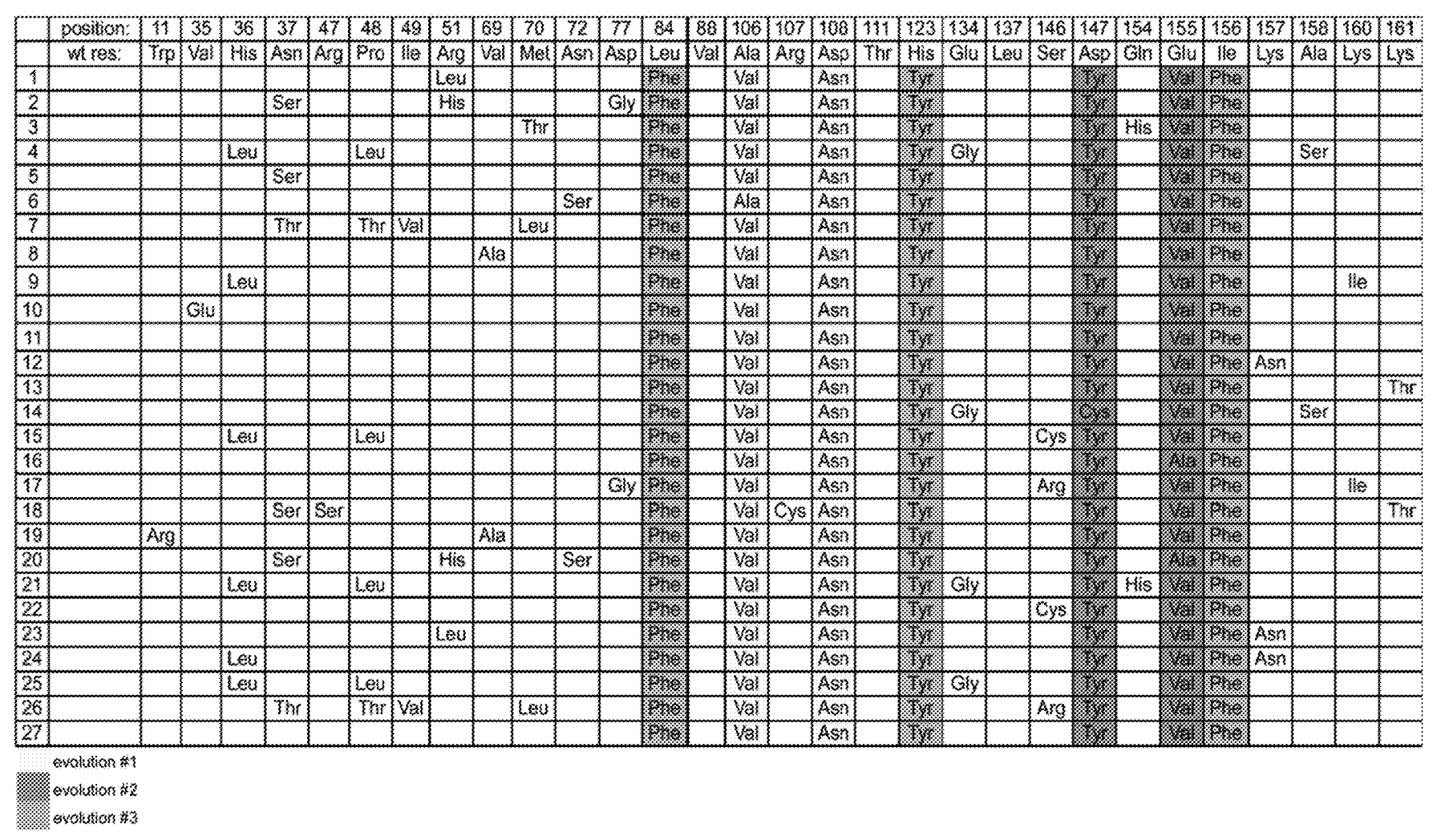

FIG. 125 is a table showing the results of clones assayed after fifth round evolution (128 ug/mL chlor, 7 h).

FIGS. 126A to 126E are tables showing the results of sub-cloned and re-transformed clones assayed after fifth round under varying conditions.

FIG. 127 is a table showing the results of amplicons from spectinomycin selection clones assayed after fifth round evolution.

Figure 128:
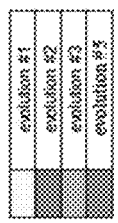

FIG. 128 is a table showing the results of clones assayed after fifth round evolution.

FIG. 129 shows a summary of results of editing at the Hek-2 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 6.

FIG. 130 shows a summary of results of editing at the Hek2-1 site using base editors that contain an engineered *S. aureus* TadA (saTadA), which include pNMG-346-349. As a comparison, results of editors that contain an engineered *E. coli* TadA (ecTadA), which include pNMG-339-341, are shown. The Hek2-1 sequence provided in the figure represents the DNA strand where A to G editing takes place. The sequence corresponds to SEQ ID NO: 465.

FIG. 131 shows a summary of results of editing at the Hek2-2 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 368.

FIG. 132 shows a summary of results of editing at the Hek2-3 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 363.

FIG. 133 shows a summary of results of editing at the Hek2-4 site using base editors that contain an engineered *S. aureus* TadA (saTadA), which include pNMG-346-349. As a comparison, results of editors that contain an engineered *E. coli* TadA (ecTadA), which include pNMG-339-341, are shown. The Hek2-4 sequence provided in the figure represents the DNA strand where A to G editing takes place. The sequence corresponds to SEQ ID NO: 466.

FIG. 134 shows a summary of results of editing at the Hek2-6 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 364.

FIG. 135 shows a summary of results of editing at the Hek2-9 site using base editors that contain an engineered *S. aureus* TadA (saTadA), which include pNMG-346-349. As a comparison, results of editors that contain an engineered *E. coli* TadA (ecTadA), which include pNMG-339-341, are shown. The Hek2-9 sequence provided in the figure represents the DNA strand where A to G editing takes place. The sequence corresponds to SEQ ID NO: 467.

FIG. 136 shows a summary of results of editing at the Hek2-10 site using base editors that contain an engineered *S. aureus* TadA (saTadA), which include pNMG-346-349. As a comparison, results of editors that contain an engineered *E. coli* TadA (ecTadA), which include pNMG-339-341, are shown. The Hek2-10 sequence provided in the figure represents the DNA strand where A to G editing takes place. The sequence corresponds to SEQ ID NO: 370.

FIG. 137 shows a summary of results of editing at the Hek3 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 42.

FIG. 138 shows a summary of results of editing at the RNF2 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 468.

FIG. 139 shows a summary of results of editing at the FANCF site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 45.

Figure 140:
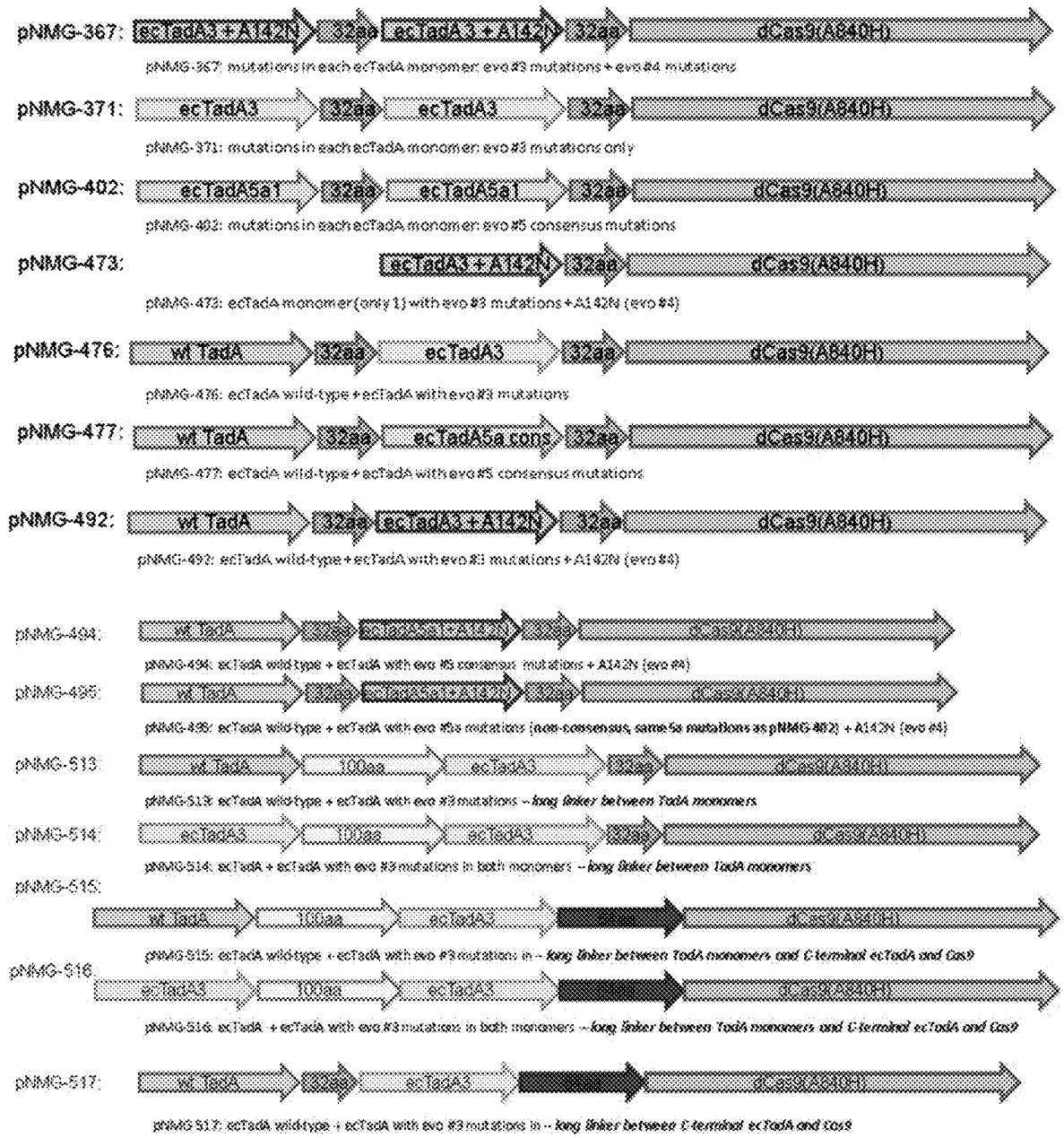
Figure 140:
Figure 140:
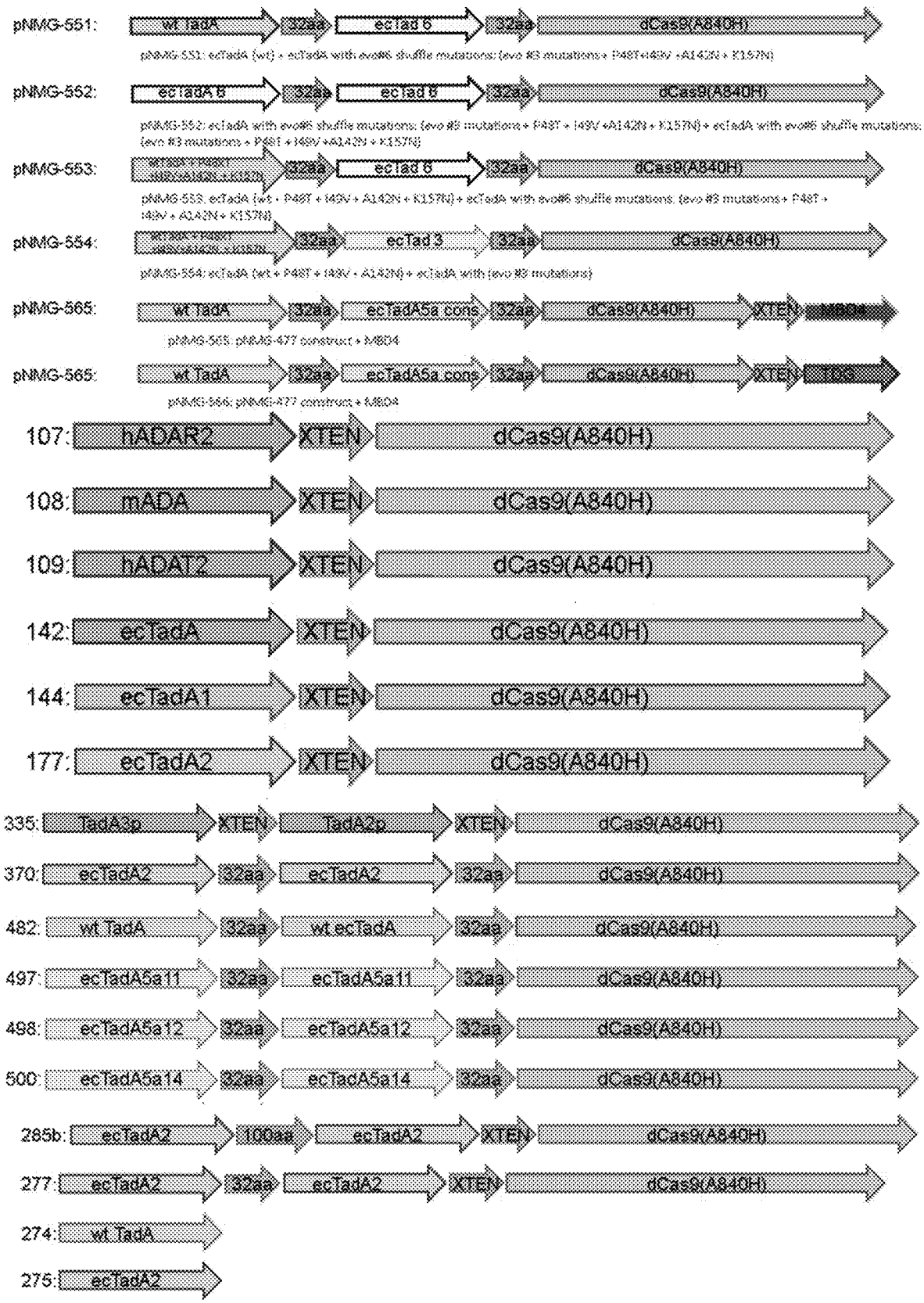
Figure 140:
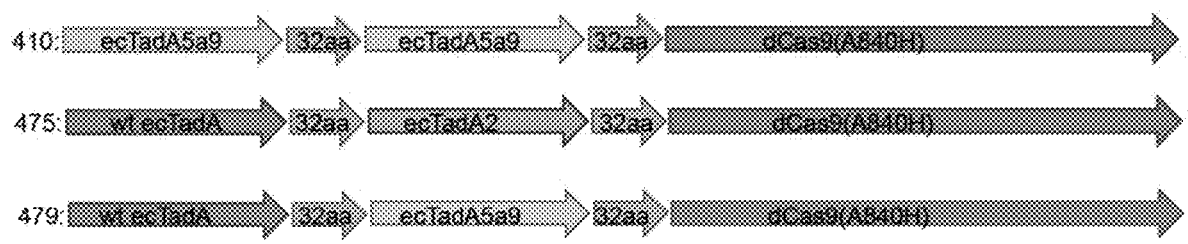

FIG. 140 shows various schematic representations of adenosine base editor (ABE) constructs. The identity of the editors e.g., "pNMG-367" is indicated in Table 4. The following mutations are abbreviated as follows: ecTadA1 (A106V D108N), ecTadA2 (A106V D108N D147Y E155V), ecTadA3 (ecTadA2+L84F H123Y I156F), ecTadA3+(ecTadA3+A142N), ecTadA5a1 (ecTadA3+H36L R51L S146C K157N), ecTadA5a3 (ecTadA3+N37S K161T), ecTadA5a11 (ecTadA3+R51L S146C K157N K161T), ecTadA5a12 (ecTadA3+S146C K161T), ecTadA5a14 (ecTadA3+RS146C K157N K160E), and ecTadA5a1+(ecTadA5a1+A142N), ecTadA5a9 (ecTadA3+S146R K161T). Heterodimers of the top three ABE 5a constructs were made and then tested relative to homodimers. The heterodimer version of the ABE editor typically performs better than the corresponding homodimeric construct. Both homodimeric and heterodimeric constructs are shown in FIG. 140.

Figure 141:
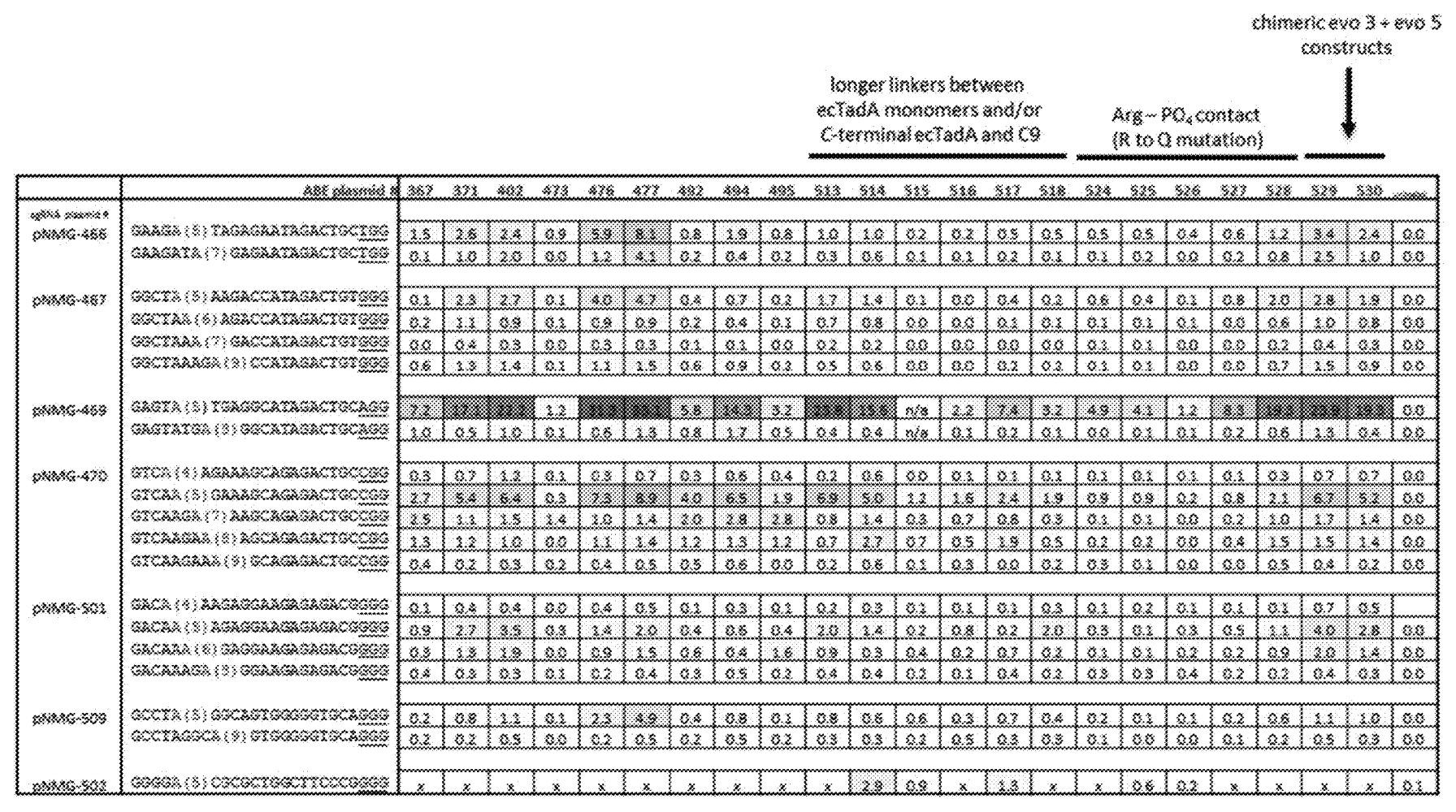

FIG. 141 shows editing results for various ABE constructs. The ABE plasmid # refers to pNMG number as indicated in Table 4. For example 367 refers to construct pNMG-367 in Table 4. The sequences correspond to SEQ ID NOs: 469 (pNMG-466), 470 (pNMG-467), 471 (pNMG-469), 472 (pNMG-470), 473 (pNMG-501), 474 (pNMG-509), and 475 (pNMG-502) from top to bottom, respectively.

FIG. 142 shows editing results for various ABE constructs at specific sites. The numbers on the top row indicate the pNMG number as indicated in Table 4. For example 107 refers to construct pNMG-107 in Table 4. In certain contexts, homodimer constructs have been shown to work better than a hetero dimer construct and vice versa (see for example construct 371 which is a homodimer versus construct 476 which is a heterodimer). Schematics for these ABE constructs are shown in FIG. 140, and the construct architecture is shown in Table 4. The sequences correspond to SEQ ID NOs: 478, 478, 514, 516, 516, 520, 520, 521, 521, and 509 from top to bottom, respectively.

FIG. 143 shows the percentage of indels formed for ABE constructs from FIG. 142.

FIG. 144 shows editing results for various ABE constructs at specific sites. The identity of the constructs are shown in the top row and refer to the pNMG reference number of Table 4. The results in FIG. 144 indicate that adding ecTadA monomer to ABE construct may not improve editing. However, adding a long linker between monomers may help editing at some sites (see, for example, the editing results for sgRNA constructs 285b versus 277 at sites 502, 505, 507). The identity of the sgRNA constructs is shown in Table 8. Schematics for these ABE constructs are shown in FIG. 140. The sequences correspond to SEQ ID NOs: 478, 480, 480, 514, 517, 517, 517, 517, 519, and 521 from top to bottom, respectively.

FIG. 145 shows results for ABE constructs at all NAN sites, where the target A is at position 5 of the Protospacer and PAM sequences. The identity of the ABE constructs, shown in the top row refers to the pNMG reference number in Table 4. The number values represent the % of target A residues that were edited (e.g., % editing efficiency). The sequences correspond to SEQ ID NOs: 537-552 from top to bottom, respectively.

Figure 146:
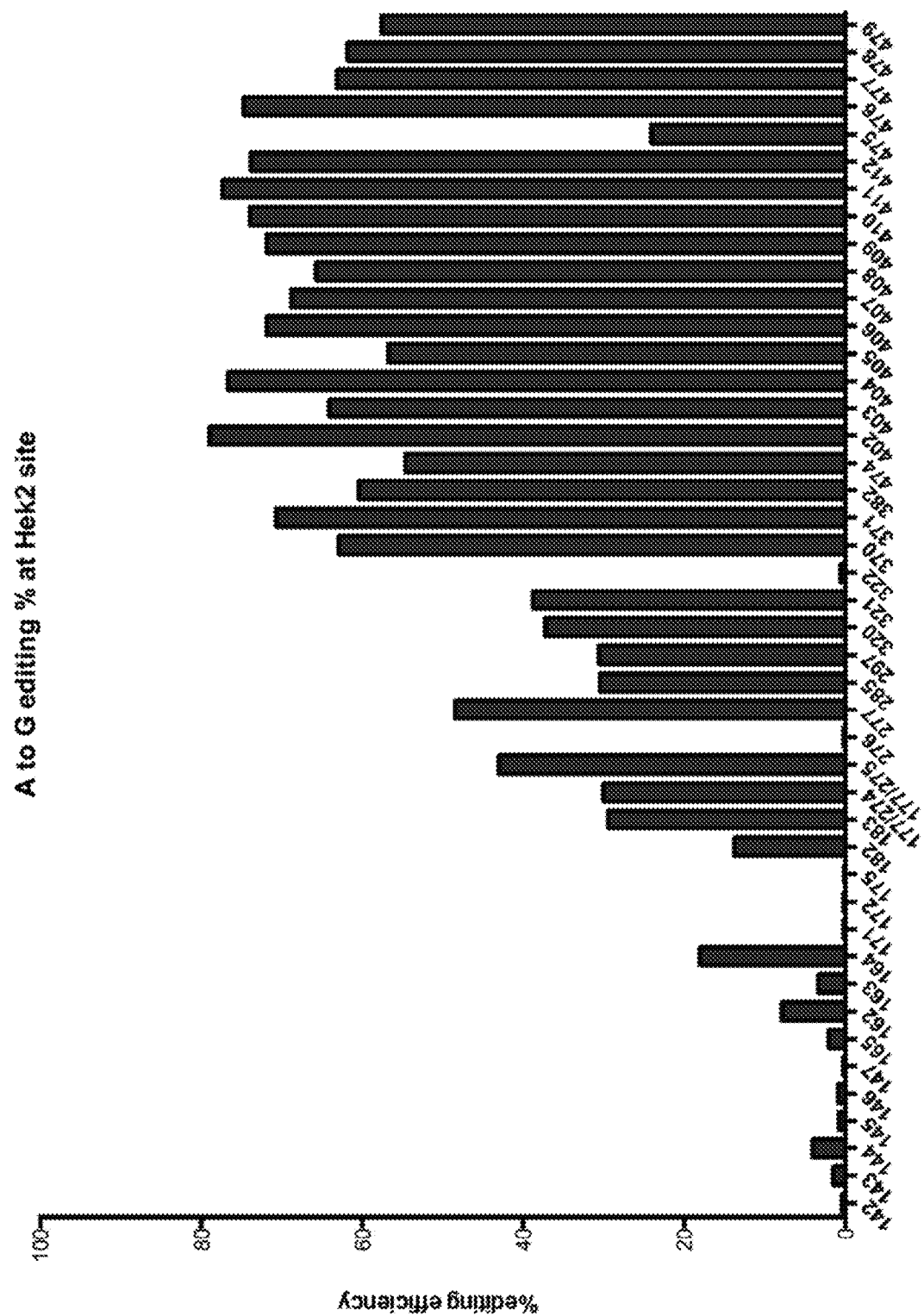

FIG. 146 shows A to G editing percent at the Hek2 site for various ABE constructs as referenced by their reference pNMG number in Table 4.

FIG. 147 shows evolution round #5b evolution results. The number values represent the % of A to G editing for the indicated sites. The sequences from top to bottom correspond to SEQ ID NOs: 7, 465, 368, 363, 364, and 370 from top to bottom, respectively.

Figure 148:
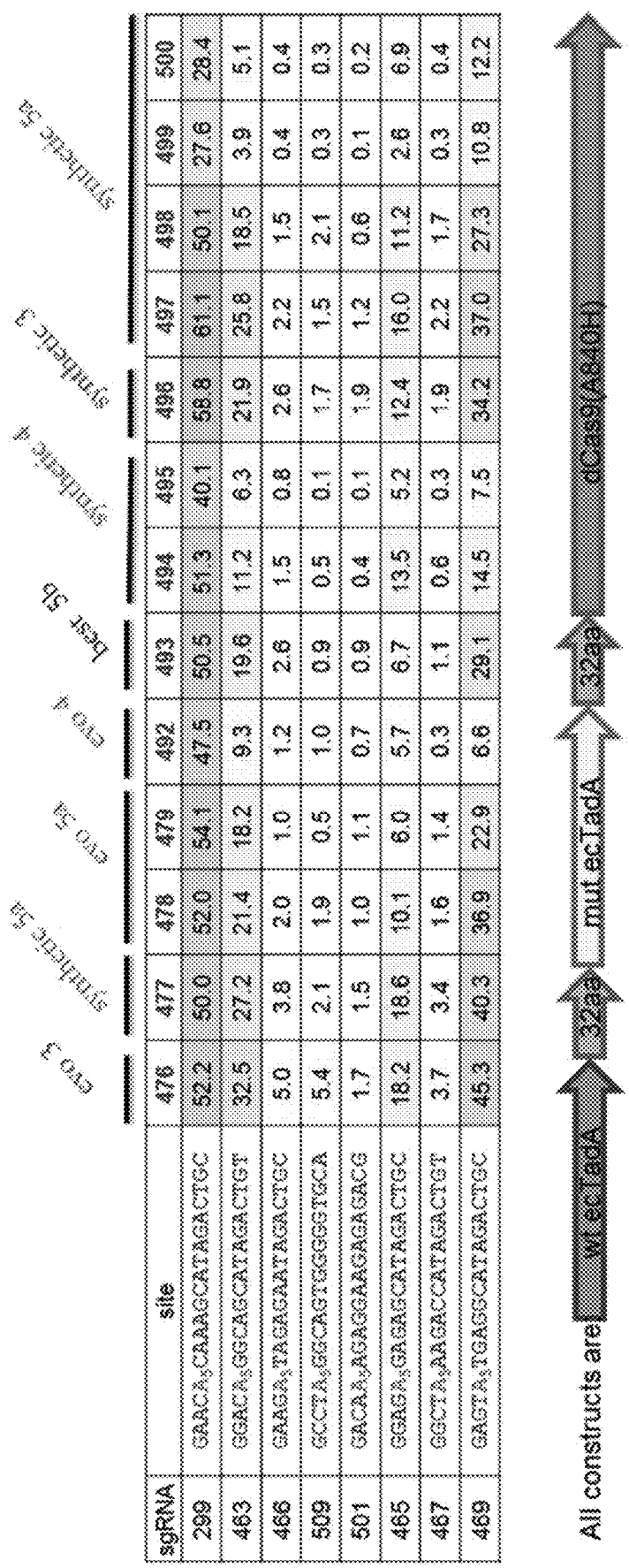

FIG. 148 shows editing results for various ABE constructs which were obtained from different rounds of evolution (e.g., evo3). The generic schematic for the ABE constructs is also shown. The identity of the sgRNA, as indicated in Table 8, and the identity of the base editors (pNMG reference), as indicated in Table 4, are shown. The number values represent the % of A to G editing for the indicated sites. The sequences correspond to SEQ ID NOs: 478, 503, 506, 521, 513, 505, 507, and 509 from top to bottom, respectively.

FIG. 149 shows examination of the ABE constructs at genomic sites other than the Hek-2 sequence. The Hek-2 site (sgRNA 299) is represented by the asterisk. The identity of the sgRNA is indicated in Table 8. The sequences correspond to SEQ ID NOs: 478, 514, 516, 517, 517, 517, 517, 519, 520, 529, 521 from top to bottom, respectively.

Figure 150:
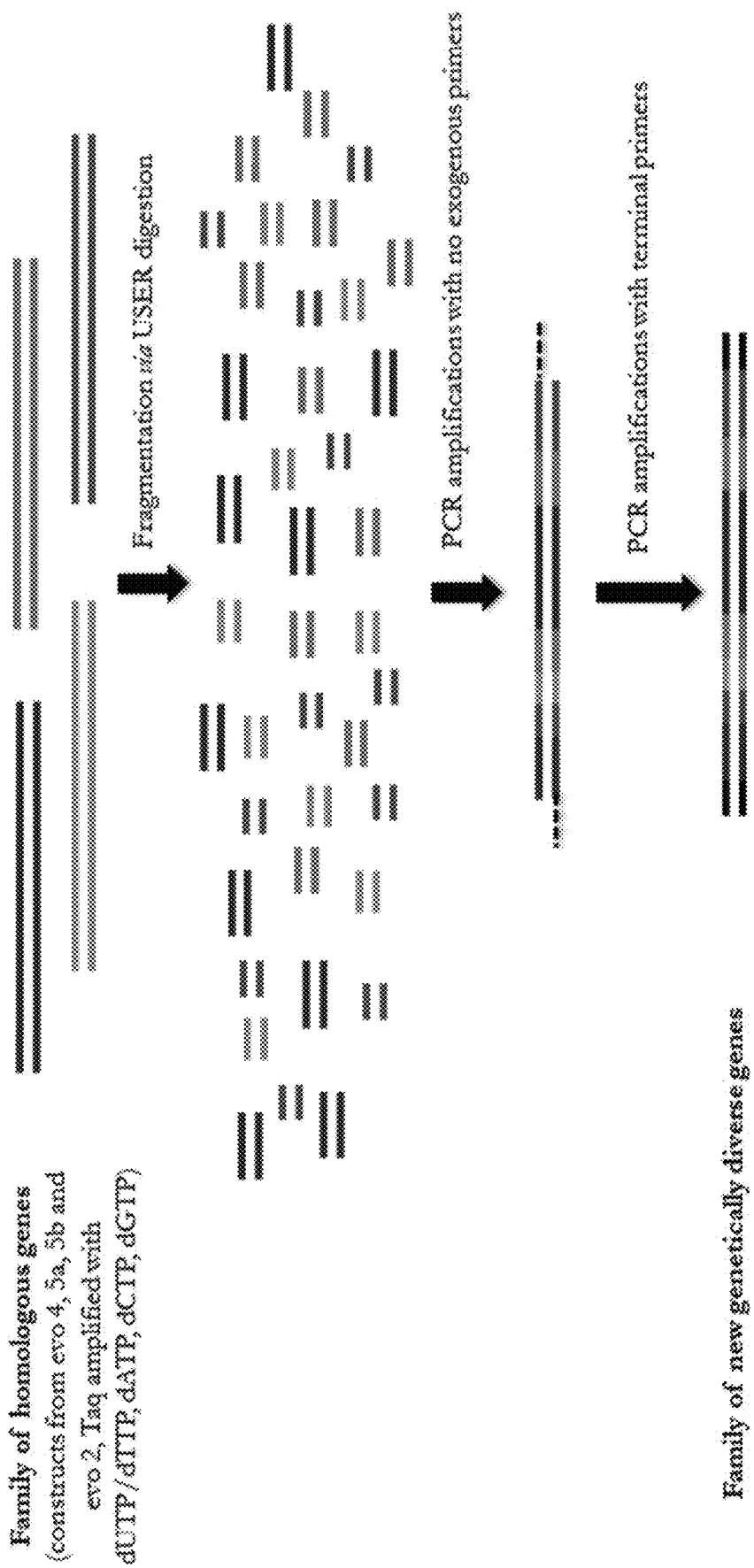

FIG. 150 shows a schematic of the DNA shuffling experiment using nucleotide exchange and excision technology (NExT), which is referred to as ABE evolution #6. The goal of this approach was to assemble a more efficient editor and remove potential epistatic mutations. DNA shuffling of constructs from various evolutions were used to optimize for desired mutations and eliminate mutations that negatively affect editing efficiencies and/or protein stability.

FIG. 151 shows a schematic for DNA Shuffle (NeXT). The spect target sequence is 5'-CAATGATGACTTCTA-CAGCG-3' (SEQ ID NO: 444) and the chlor target sequence is 5'-TACGGCGTAGTGCACCTGGA-3' (SEQ ID NO: 441).

Figure 152:
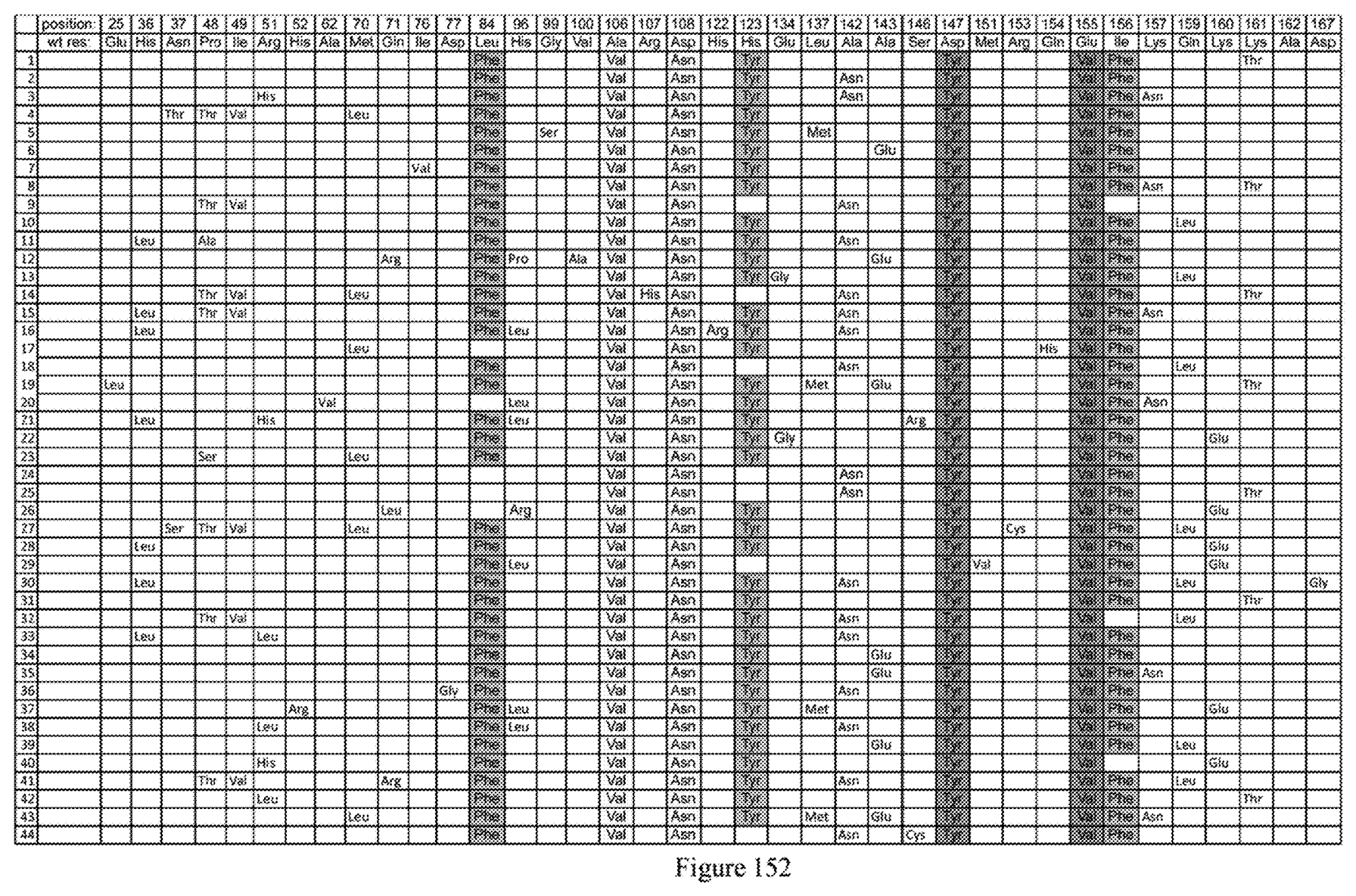

FIG. 152 shows the sequence identity of clones from evolution #6 surviving on spect only (non-YAC target). The mutations indicated are relative to ecTadA (SEQ ID NO: 1).

Figure 153:
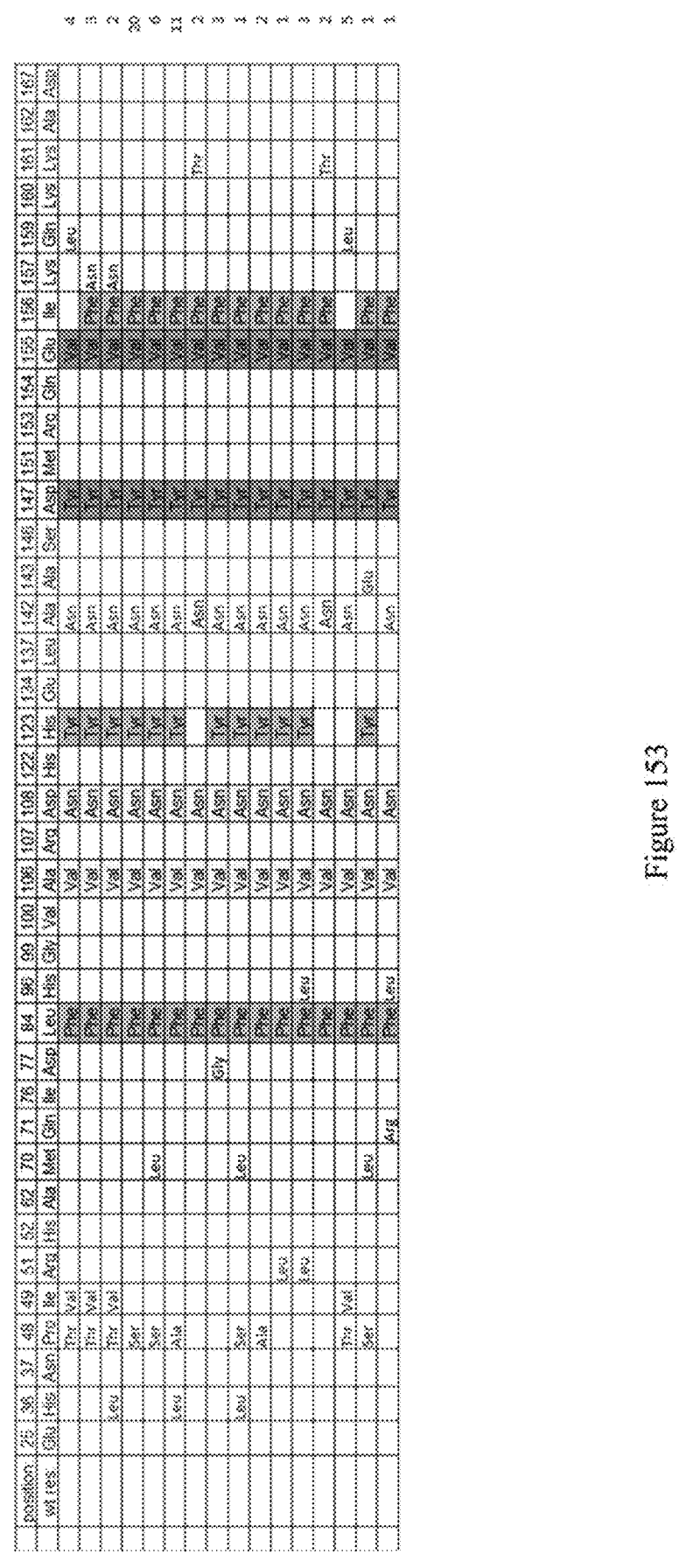

FIG. 153 shows evolution #6.2 which refers to the enrichment of clones from evolution #6. The mutations indicated are relative to ecTadA (SEQ ID NO: 1). A142N is present in almost all clones sequenced and the Pro48 mutation is also abundant. The clones were selected against "GAT" in the spectinomycin site. The selection target sequence was 5'-CAATGATGACTTCTACAGCG-3' (SEQ ID NO: 444).

Figure 154:
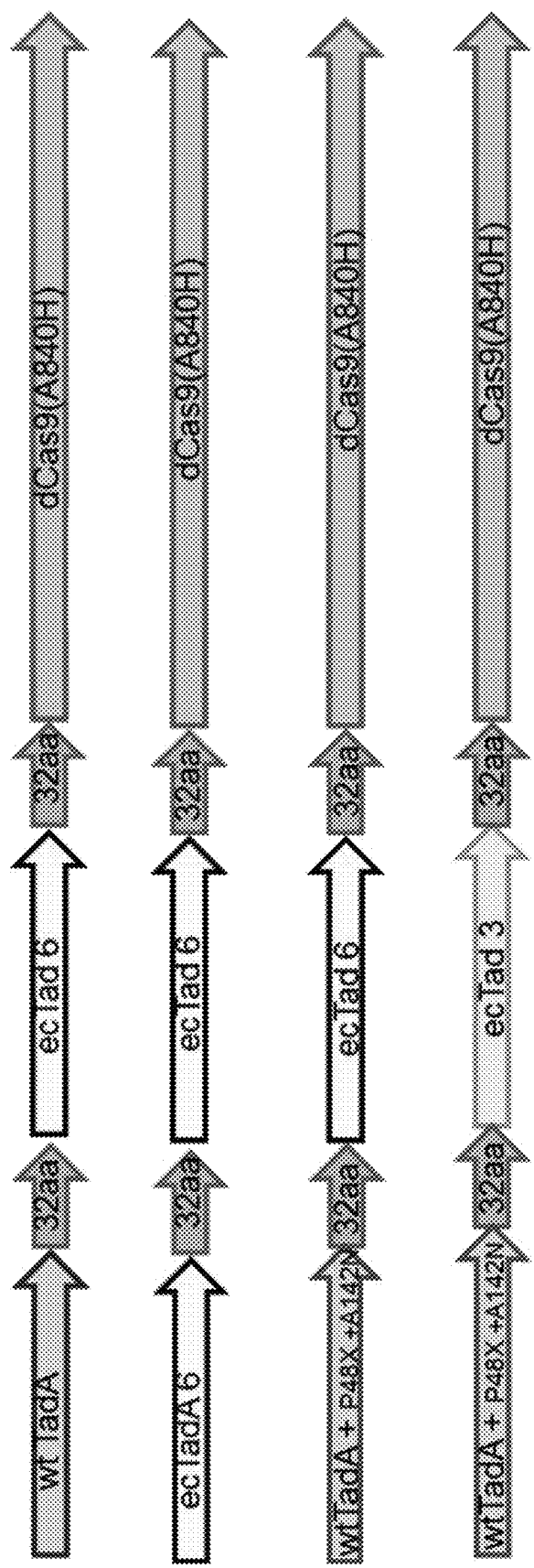

FIG. 154 shows schematic representations of ABE 6 constructs. 8 new constructs in total were developed. Mutations from the top 2 highest frequency amplicons in Evo #6 were used in each of the four architectures.

FIG. 155 shows data harvesting for ABE: step 1—transfection+HTS of key intermediates at 6 genomic sites, n=3. The transfection was performed with 750 ng ABE+250 ng gRNA and incubated for 5 days before the genomic DNA was extracted to perform HTS. The identity of each of the ABE constructs is indicated by the pNMG reference number as shown in Table 4. The sequences correspond to SEQ ID NOs: 509, 510, 512, 520, 530, 478 from top to bottom, respectively.

Figure 156:
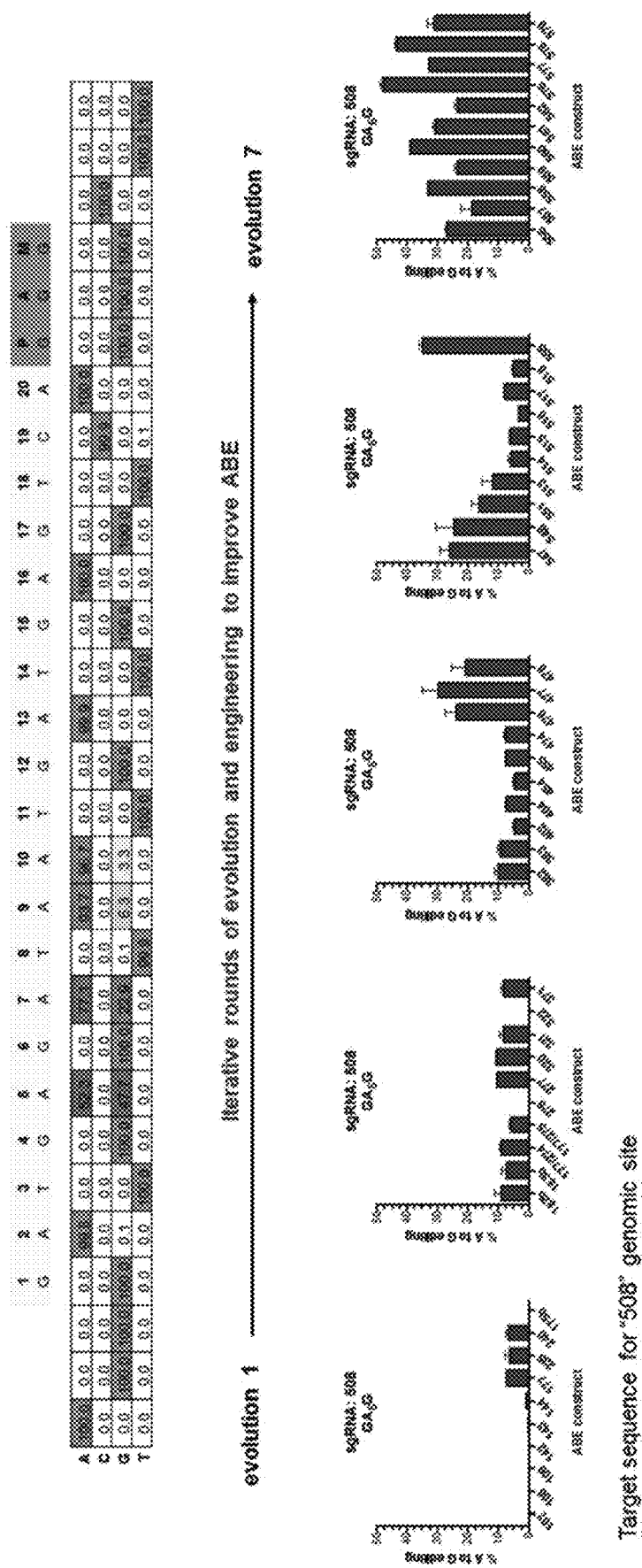

FIG. 156 shows that ABE editing efficiencies improve with iterative rounds of evolution. The top panel shows representative A to G % editing at targeted genetic locus in Hek293T cells using evolved/engineered ABE construct. The sequence corresponds to SEQ ID NO: 561. The bottom panel shows that iterative rounds of evolution and engineering improve ABE. ABE constructs are indicated by their pNMG reference numbers as shown in Table 4. The '508' target sequence corresponds to SEQ ID NO: 520.

Figure 157:
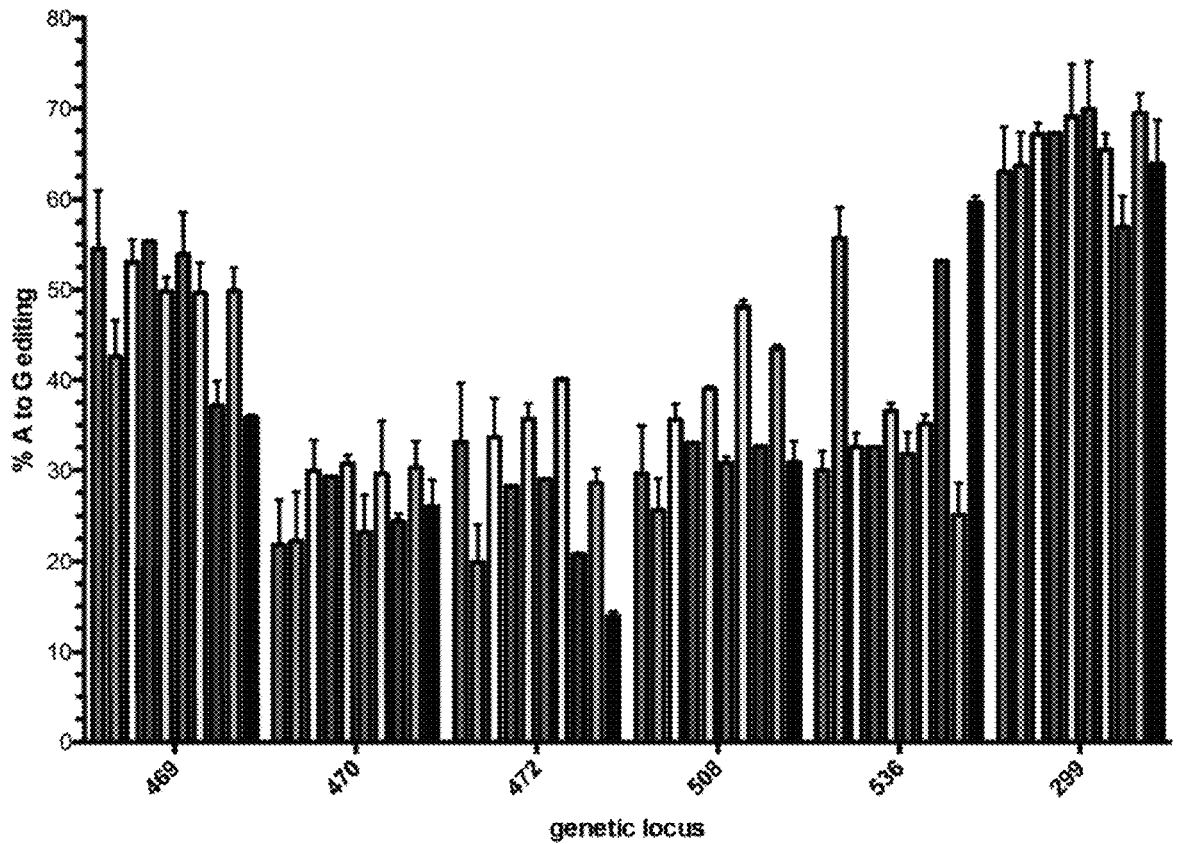

FIG. 157 shows HTS results of core 6 genomic sites from the 10 "Best" ABE. The results indicate that different editors have different local sequence preference (bottom panel). The graph shows the A to G percent editing at 6 different genetic loci. ABE constructs are indicated by their pNMG reference numbers as shown in Table 4. The sequences correspond to SEQ ID NOs: 509, 510, 512, 520, 530, 478 from top to bottom, respectively.

Figure 158:
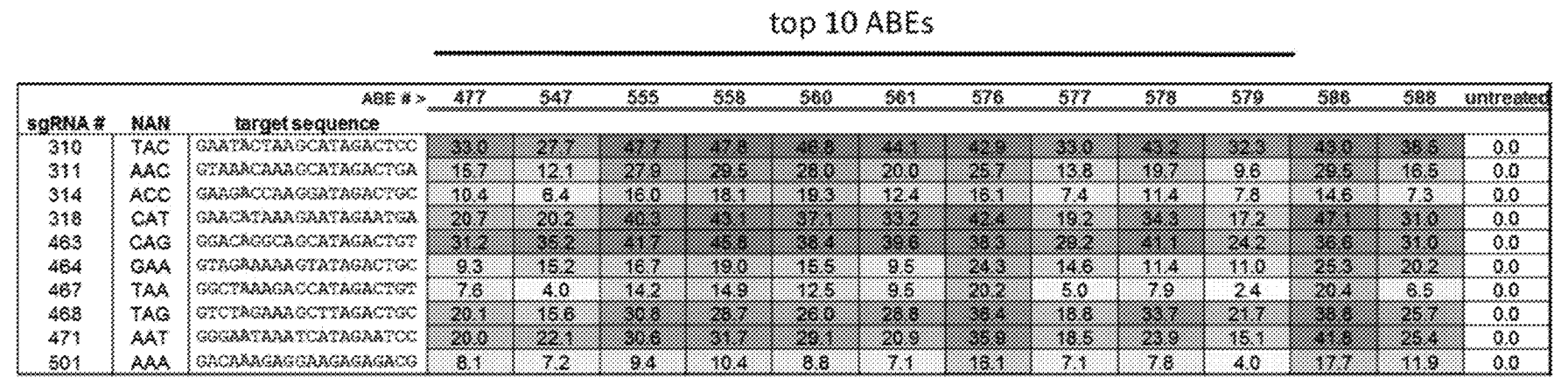

FIG. 158 shows transfection of functioning "top 10" ABEs at all genomic sites covering every combination of NAN sequence. The data represents n=1. The sequences correspond to SEQ ID NOs: 489, 490, 493, 497, 503, 504, 507, 508, 511, and 513 from top to bottom, respectively.

Figure 159:
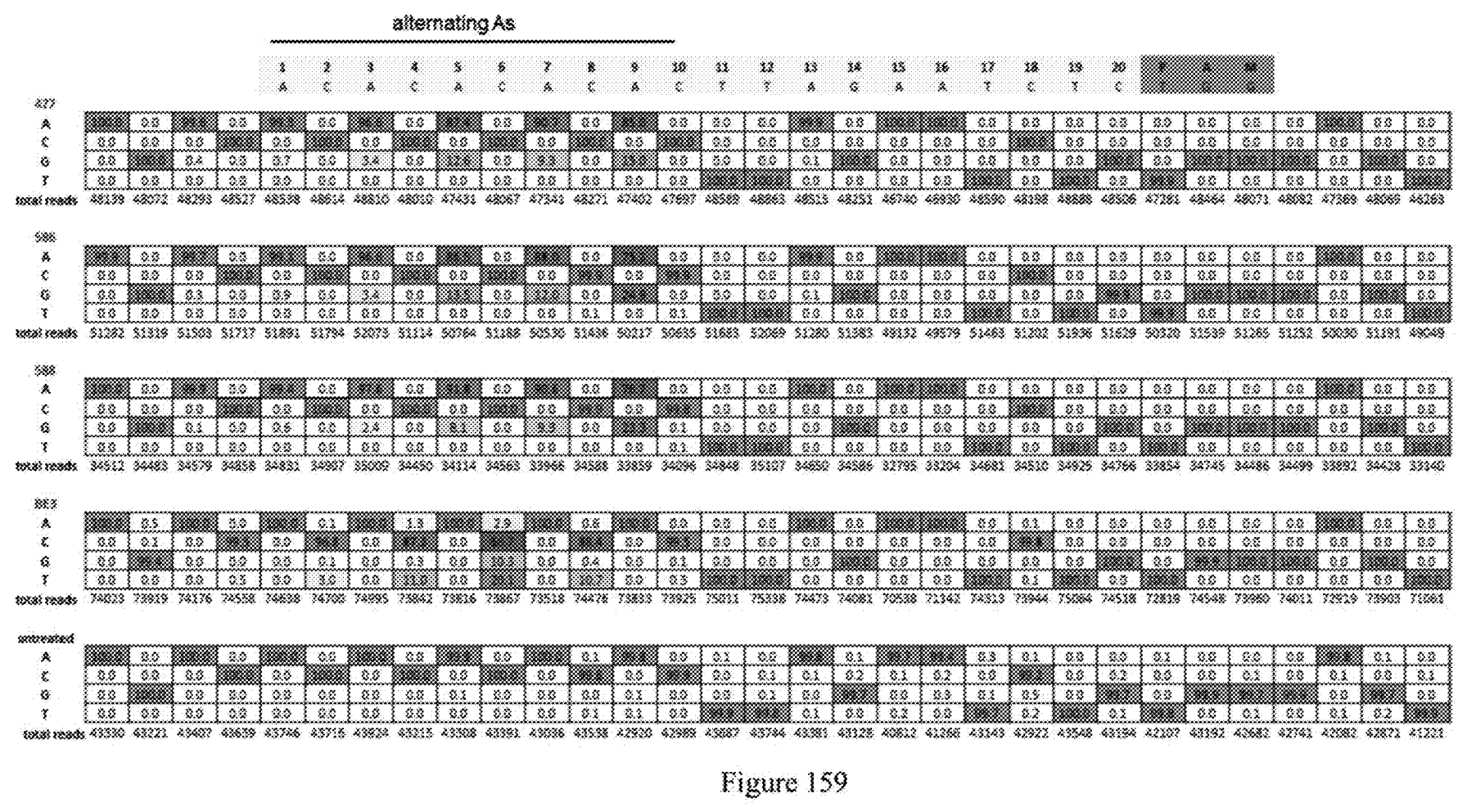

FIG. 159 shows ABE window experiments (A's at odd positions) for identifying which A's are edited. ABEs pNMG-477, pNMG-586, pNMG-588, BE3 and untreated control are shown. The sequence for editing is shown at the top. The sequence corresponds to SEQ ID NO: 562.

Figure 160:
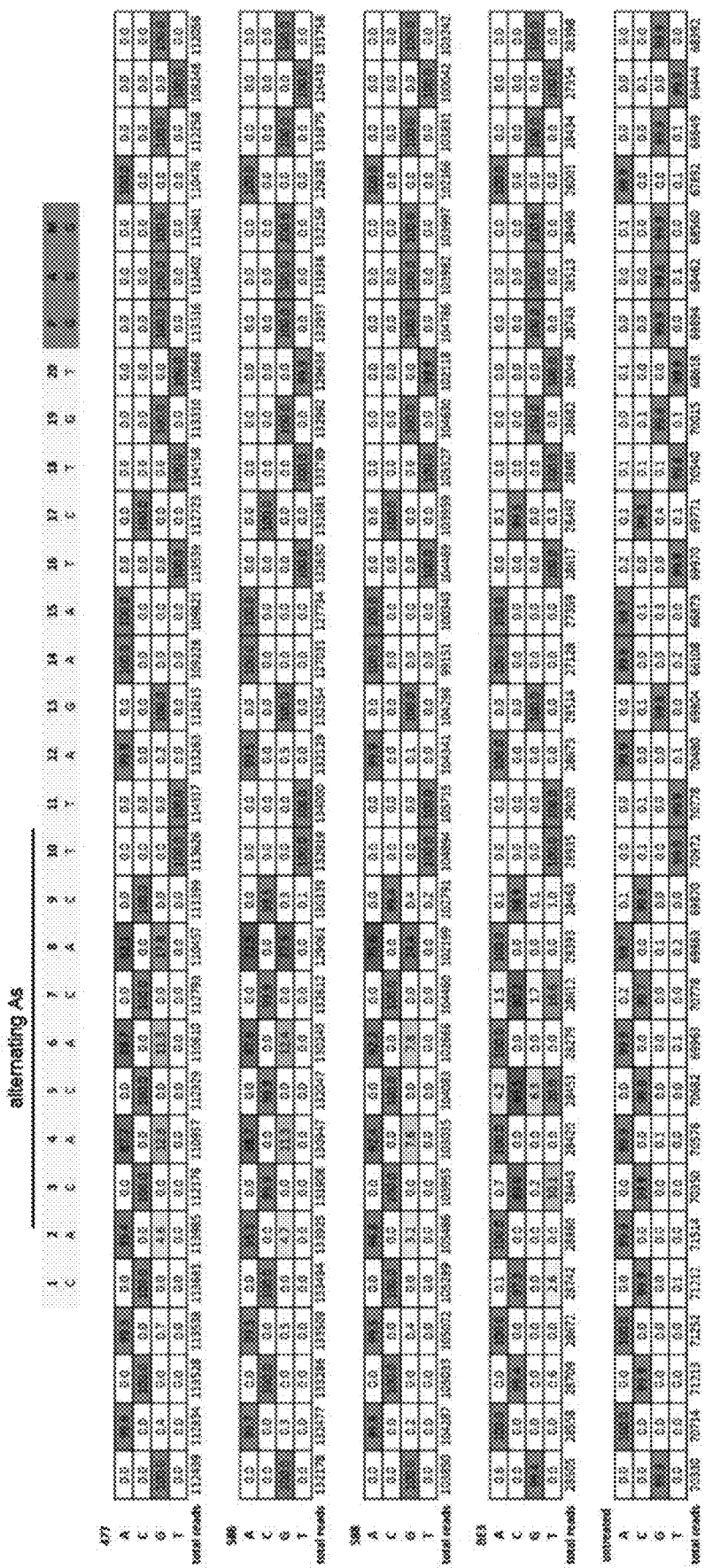

FIG. 160 shows ABE window experiment (A's at even positions) for identifying which A's are edited. ABEs pNMG-477, pNMG-586, pNMG-588, BE3 and untreated control are shown. The sequence for editing is shown at the top. The sequence corresponds to SEQ ID NO: 563.

Figure 161:
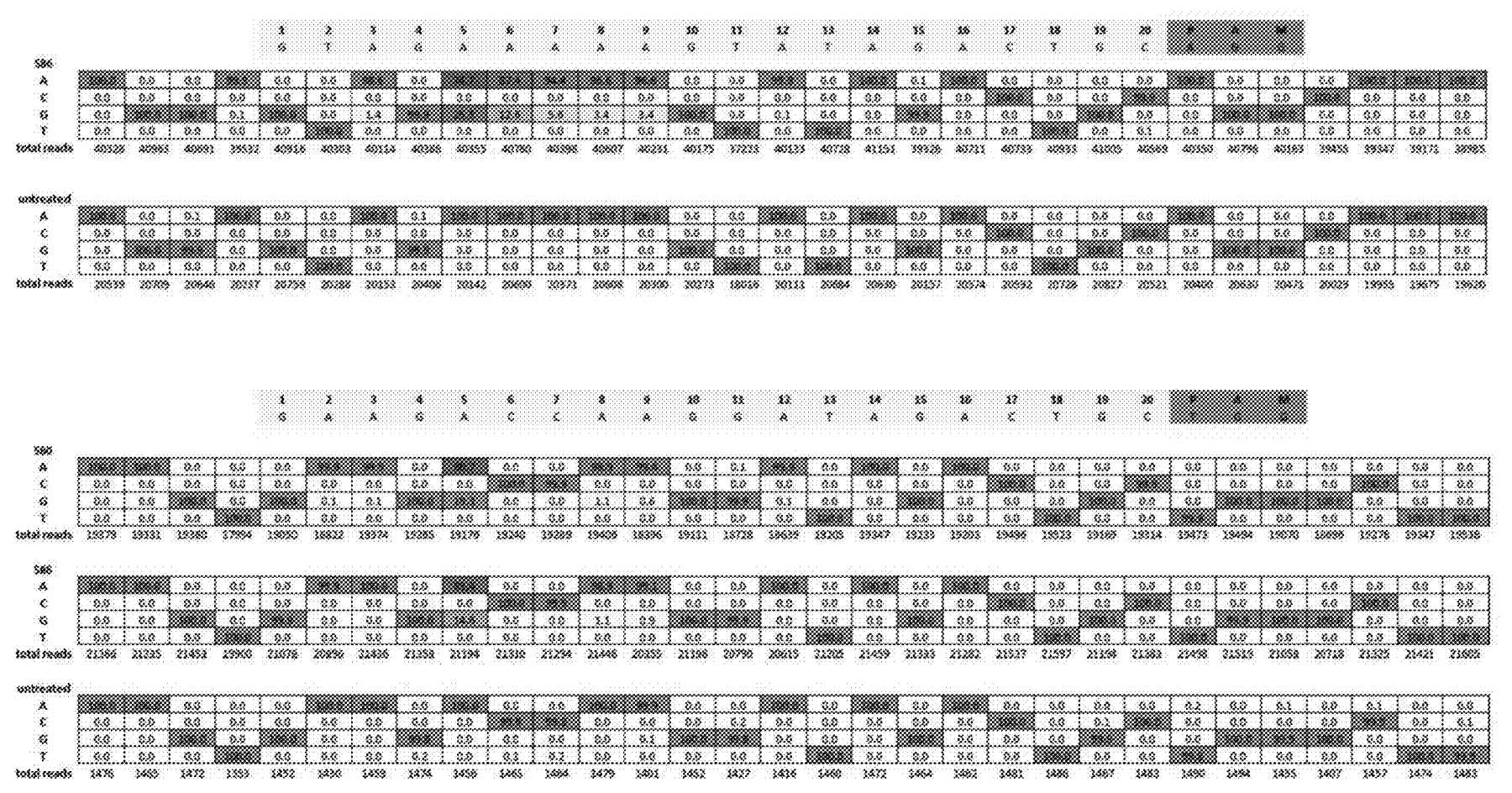

FIG. 161 shows additional ABE window experiments for identifying which A's are edited. ABEs pNMG-586, pNMG-560, and untreated control are shown. The sequence for editing is shown at the top. The sequences correspond to SEQ ID NOs: 544 and 541 from top to bottom, respectively.

Figure 162:
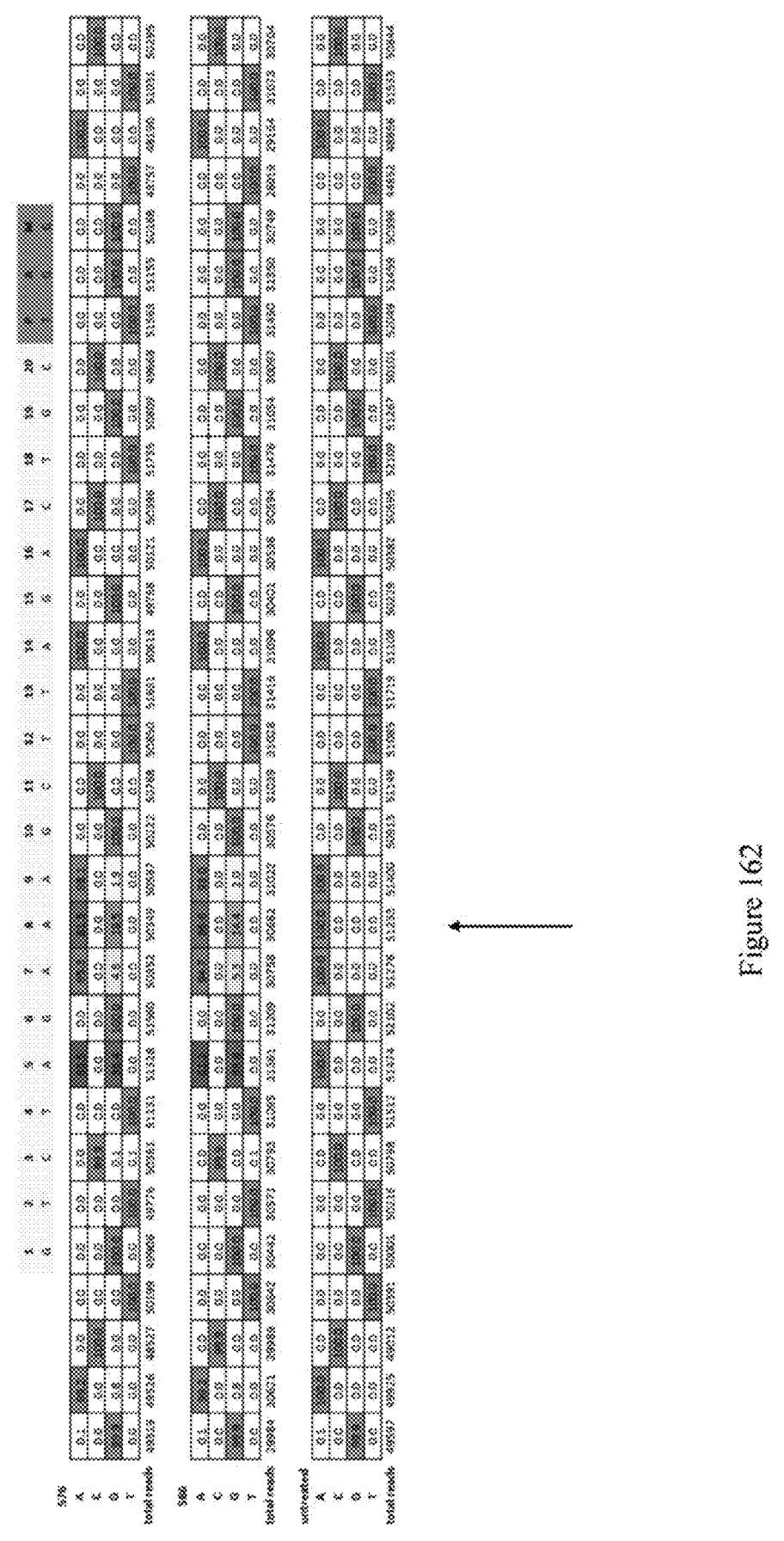

FIG. 162 shows additional ABE window experiments for identifying which A's are edited. ABEs pNMG-576, pNMG-586, and untreated control are shown. The sequence for editing is shown at the top. The sequence corresponds to SEQ ID NO: 564.

FIG. 163 shows evolution #7 an attempt to edit a multi-A site. The evolution selection design was to target 2 point mutations in the same gene using two separate gRNAs: 5'-TTCATTA(7)ACTGTGGCCGGCT-3'(SEQ ID NO: 565) and 5'-ATCTTA(6)TTCGATCATGCGAA-3' (SEQ ID NO: 566) in order to make a D208N reversion mutation in Kan and to revert a stop codon to a Q.

Figure 164:
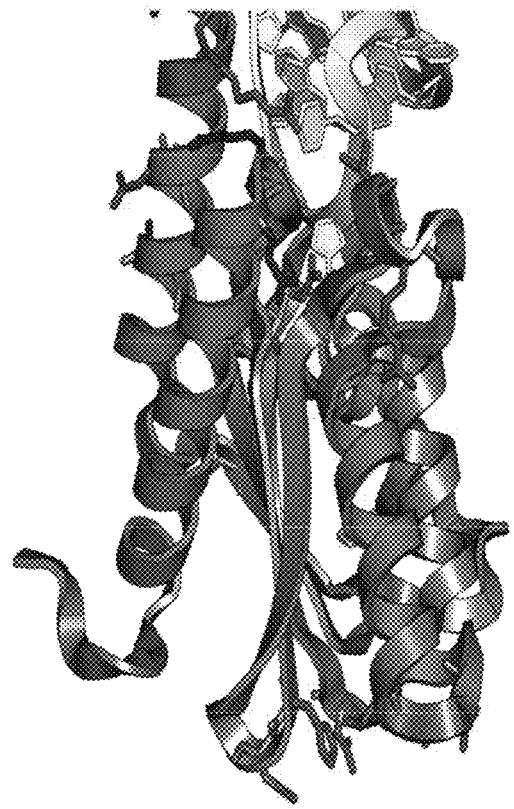

FIG. 164 shows evolution #7 mutations which were evolved to target As within a multi A site, meaning that they are flanked on one or both sides by an A. The identity of mutations, relative to SEQ ID NO: 1 are shown.

Figure 165:
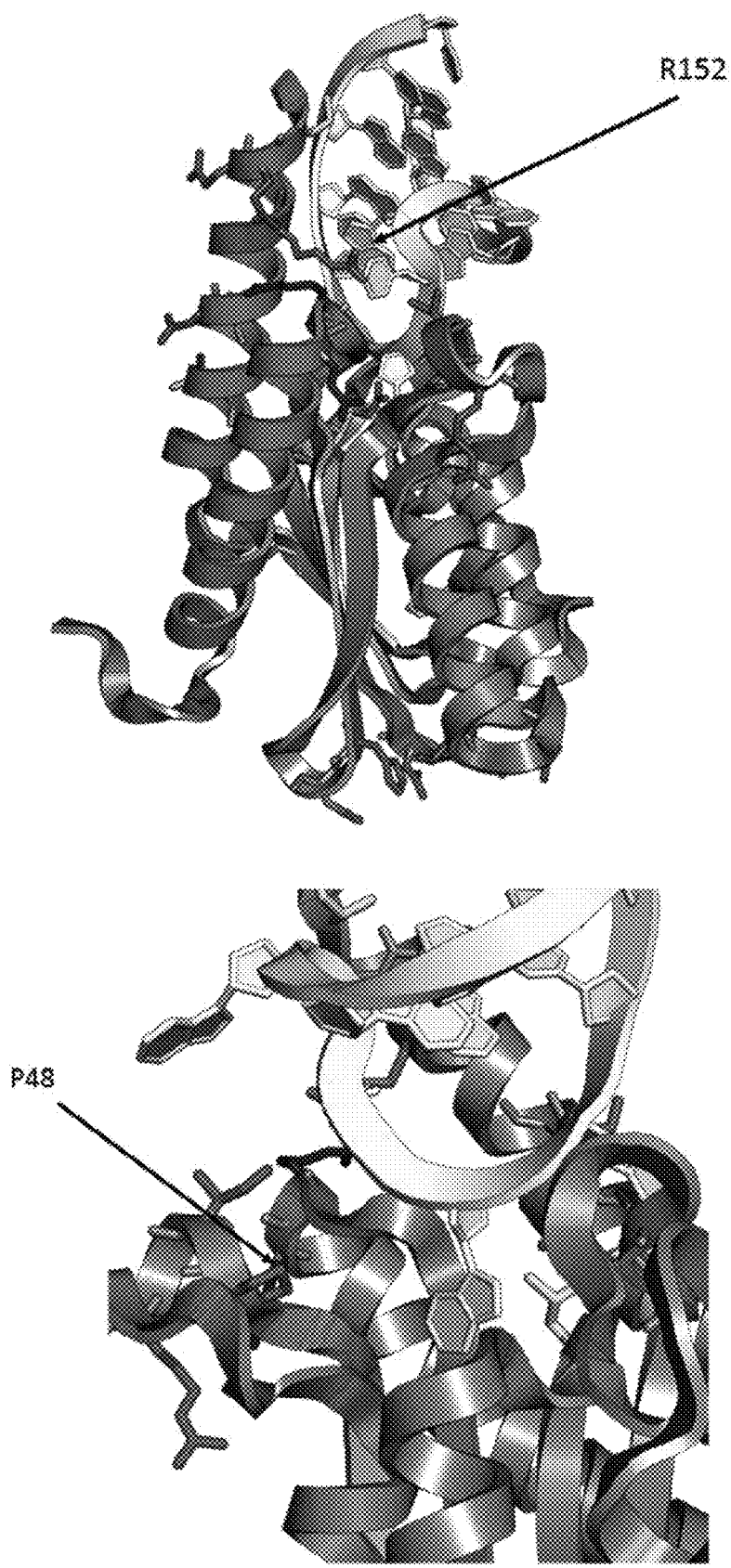

FIG. 165 shows schematics of ecTadA identifying residues R152 and P48.

FIG. 166 shows MiSeq results of ABE editing on disease relevant mutations in alternative cell lines. Nucleofection with Lonza kit was used with 3 different nucleofection solutions×16 different electroporation conditions (48 total conditions/cell line). The sequences correspond to SEQ ID NOs: 522-524 from top to bottom, respectively.

Figure 167:
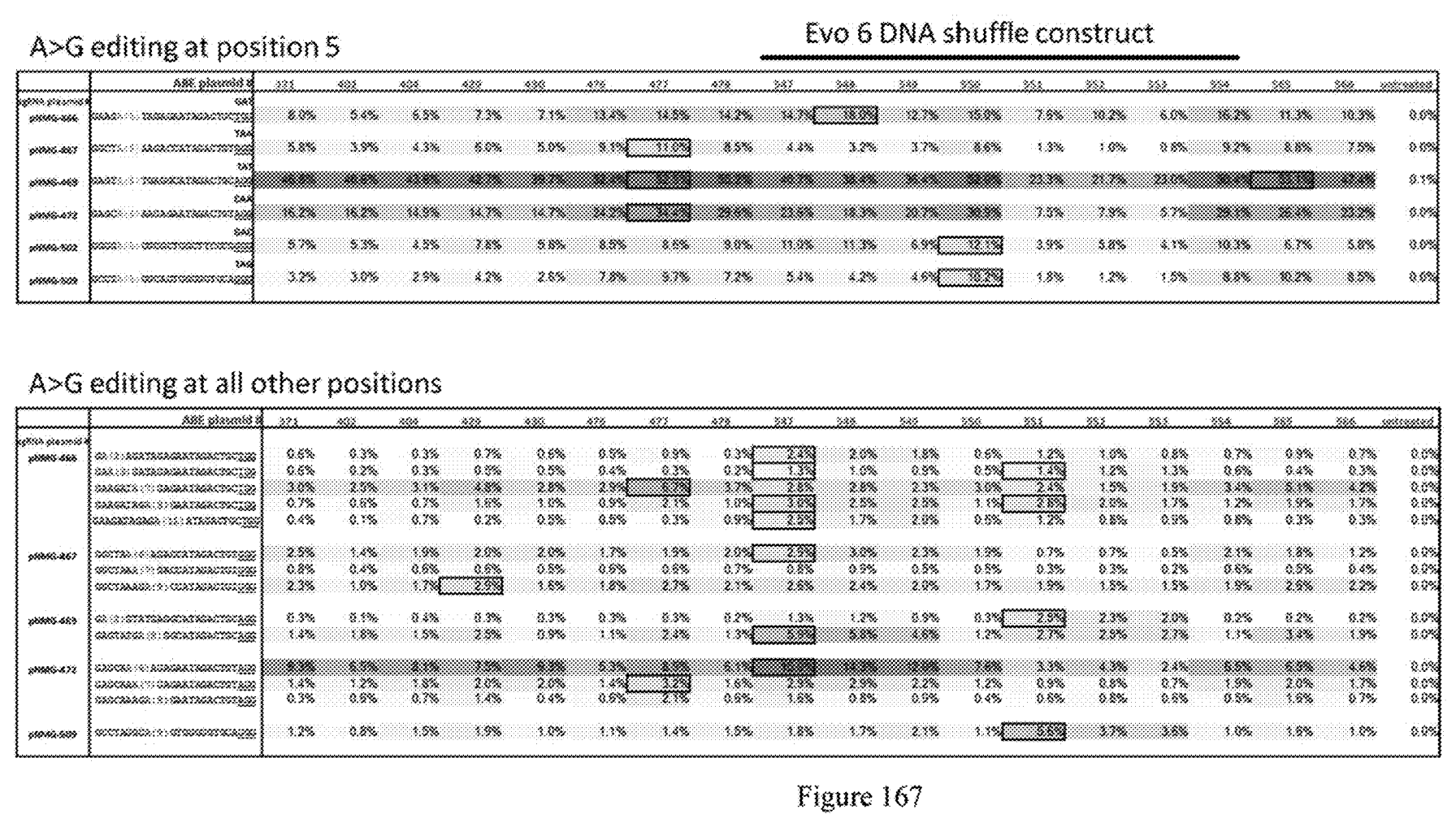

FIG. 167 shows results for A to G editing at multiple positions for various constructs. ABE constructs are indicated by their pNMG reference numbers as shown in Table 4. In the top panel the sequences correspond to SEQ ID NOs: 469-471, 567, 475, and 474 from top to bottom, respectively. In the bottom panel the sequences correspond to SEQ ID NOs: 469 (pNMG-466), 470 (pNMG-467), 471 (pNMG-469), 567 (pNMG-472), and 474 (pNMG-509) from top to bottom, respectively.

Figure 168:
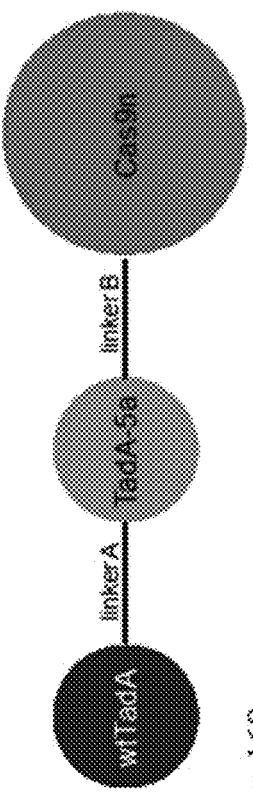

FIG. 168 shows editing results for various constructs using ABEs with different linkers. ABE constructs are indicated by their pNMG reference numbers as shown in Table 4. A schematic of the new linker ABE is also shown. The sequences correspond to SEQ ID NOs: 469 (pNMG-466), 568 (pNMG-468), 471 (pNMG-469), 567 (pNMG-472), 574 (pNGM-509), and 569) (pNMG-539) from top to bottom, respectively.

Figure 169:
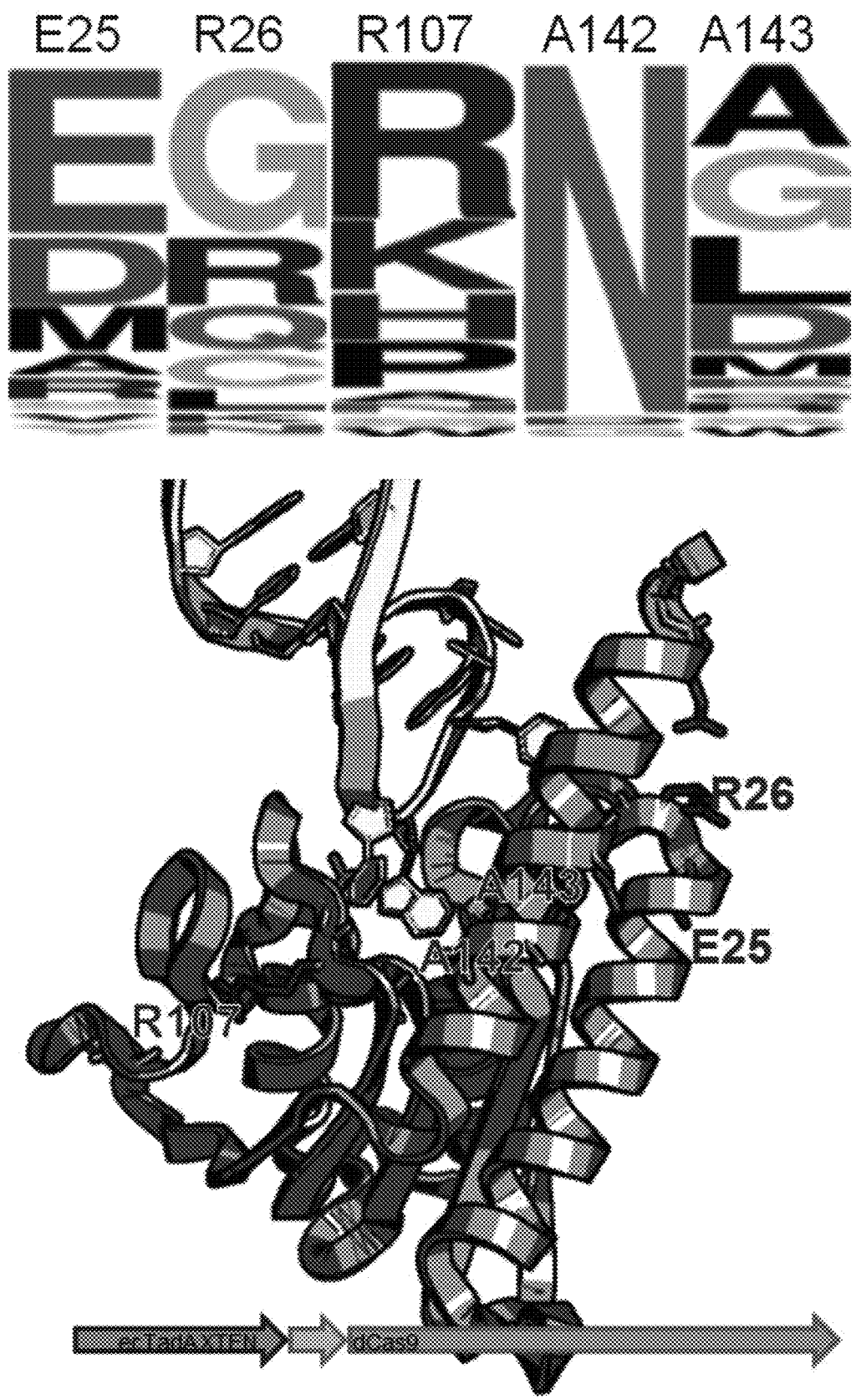

FIG. 169 shows the 4$^{th}$ round evolution. Evolution was done with a monomer construct and endogenous TadA complements TadA-dCas9 fusion.

FIG. 170 shows 4$^{th}$ round evolution results. The sequences correspond to SEQ ID NOs: 7, 368, 363, 364, 369, and 370 from top to bottom, respectively.

Figure 171:
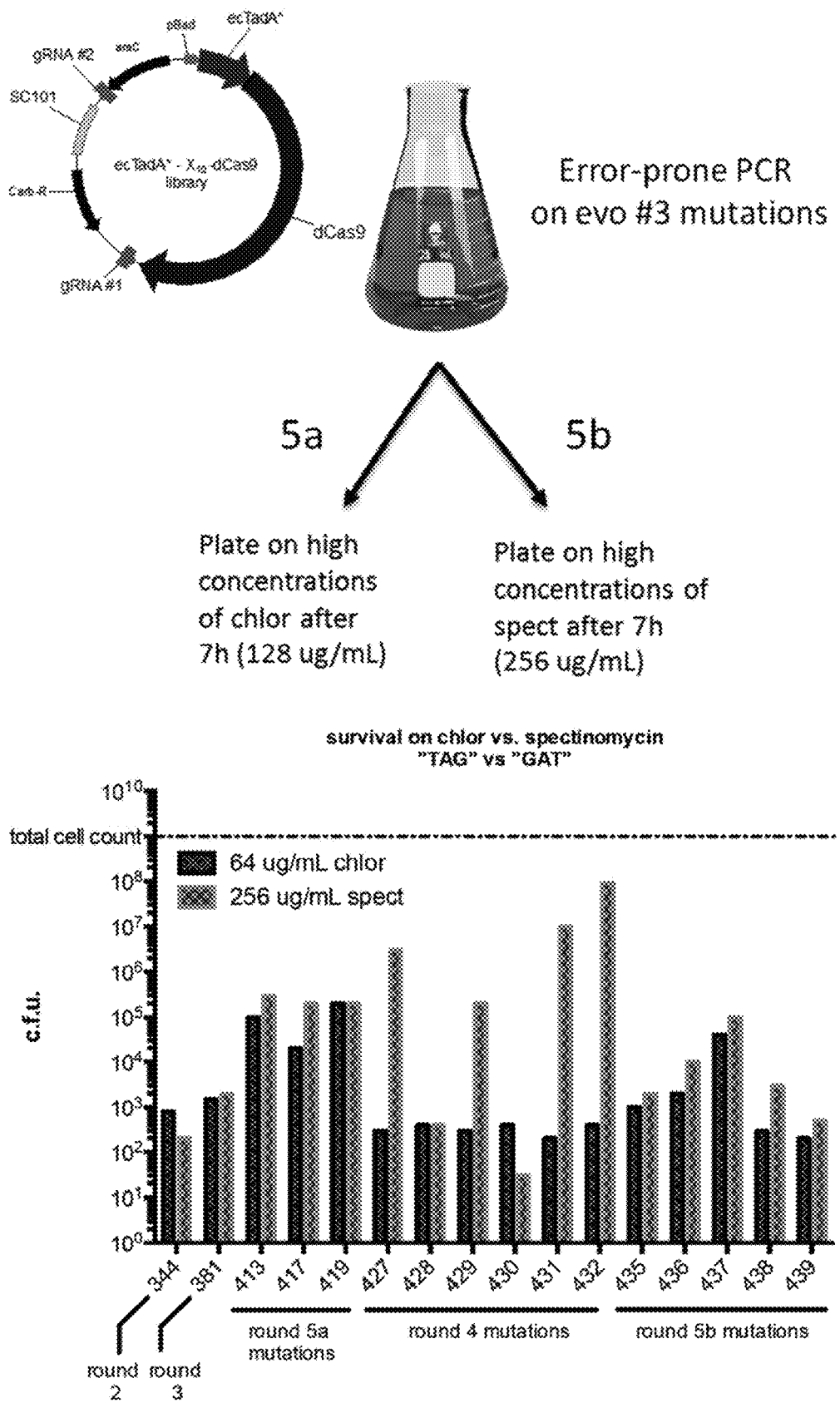

FIG. 171 shows evolution round #5. The plasmid and experimental outline are shown (top panel). The graph illustrates survival on chlor vs. spectinomycin "TAG" vs. "GAT." The chlor target sequence is 5'-TACGGCGT AGTGCACCTGGA-3' (SEQ ID NO: 441) and the spect target sequence is 5'-CAATG ATGACTTCTACAGCG-3'(SEQ ID NO: 444).

Figure 172:
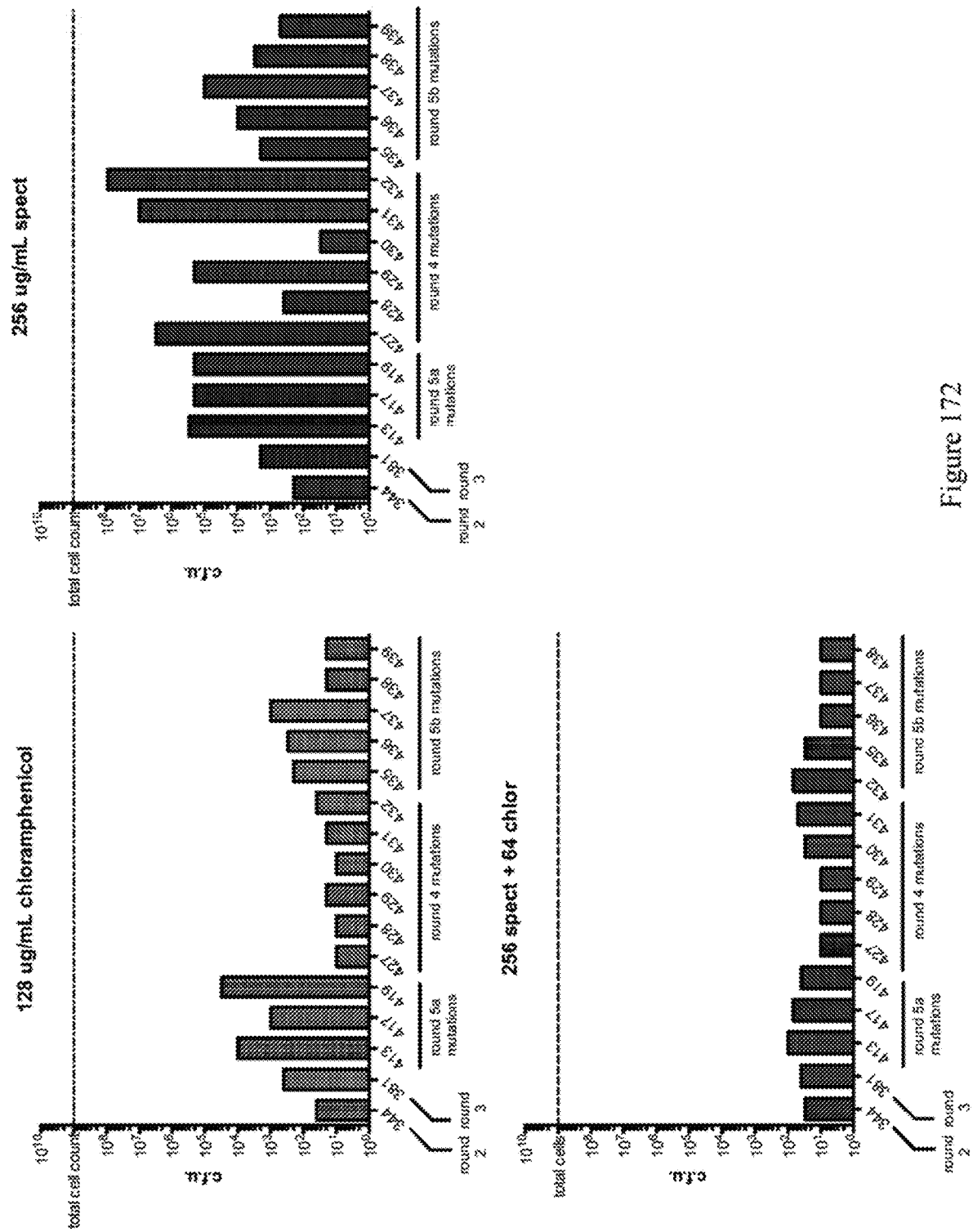

FIG. 172 shows editing results at the chlor and spect sites. Constructs identified from evolution #4 (site saturated/NNK library) appear edit more efficiently on the spect site rather than on the chor site. ABE constructs are indicated by their pNMG reference numbers as shown in Table 4.

Figure 173:
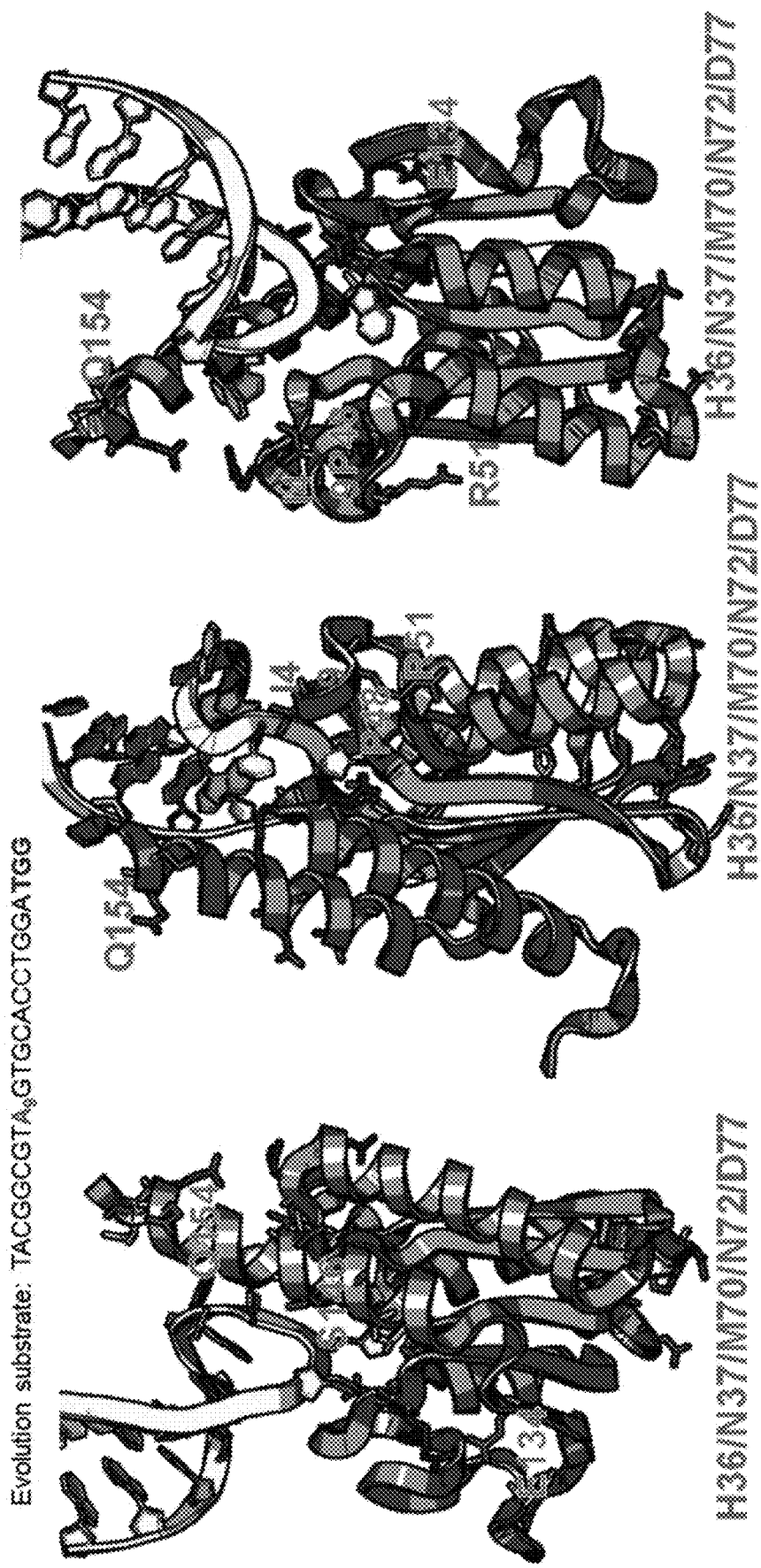

FIG. 173 shows 5th round evolution (part a). The sequence corresponds to SEQ ID NO: 570.

Figure 174:
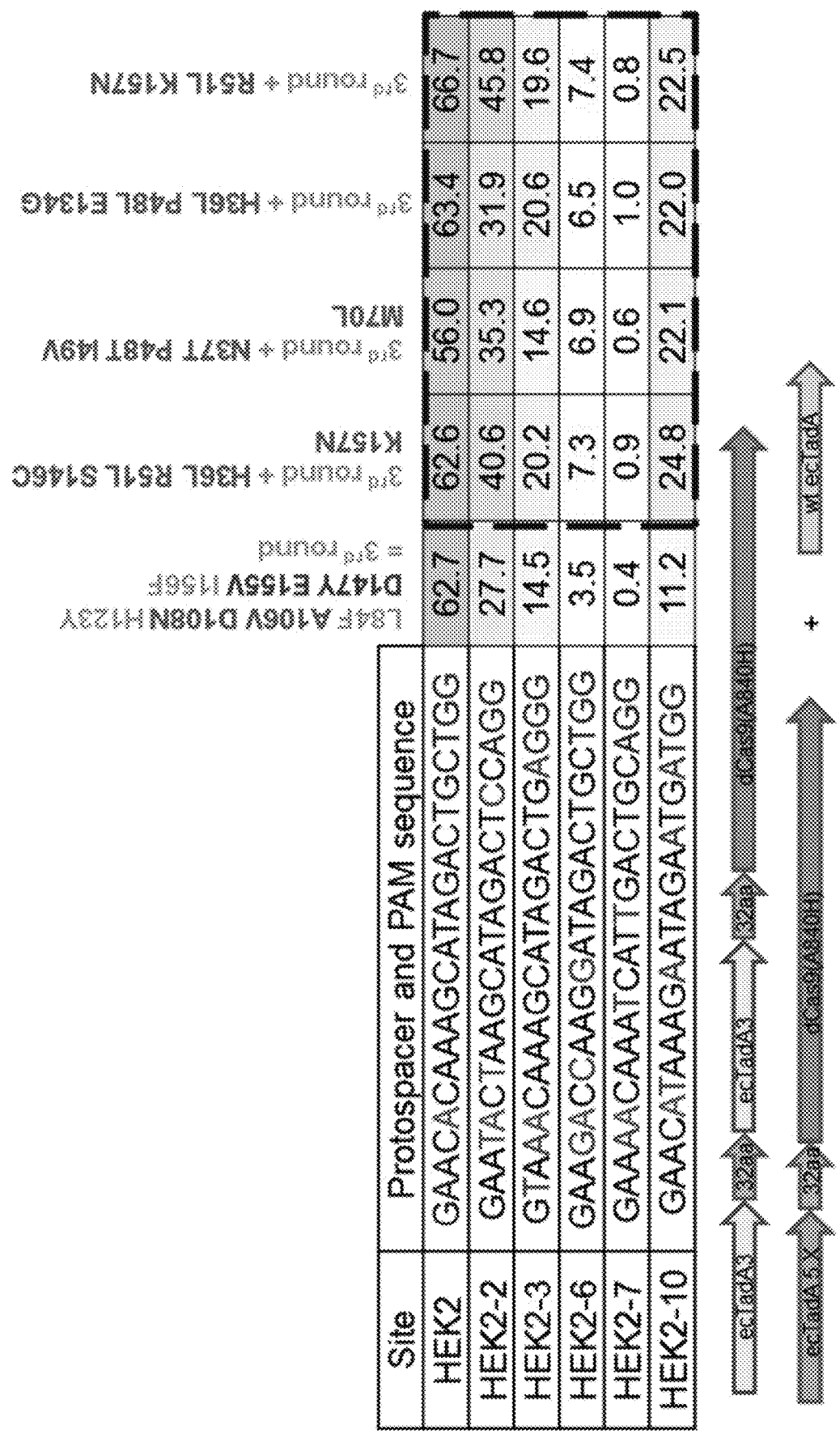

FIG. 174 shows 5th round heterodimer (in trans) results. Round #5a identified mutations improved both editing efficiencies and broadened substrate specificity. The sequences correspond to SEQ ID NOs: 7, 368, and 363, 364, 369, and 370 from top to bottom, respectively.

FIG. 175 shows 5th round heterodimer (in cis) results. Round #5a identified mutations improved both editing efficiencies and broadened substrate specificity, but the cis results gave higher editing efficiencies. ABE constructs are indicated by their pNMG reference numbers as shown in Table 4. The sequences correspond to SEQ ID NOs: 7, 571, 465, 368, 363, 466, 364, 369, 572, and 370 from top to bottom, respectively.

Figure 176:
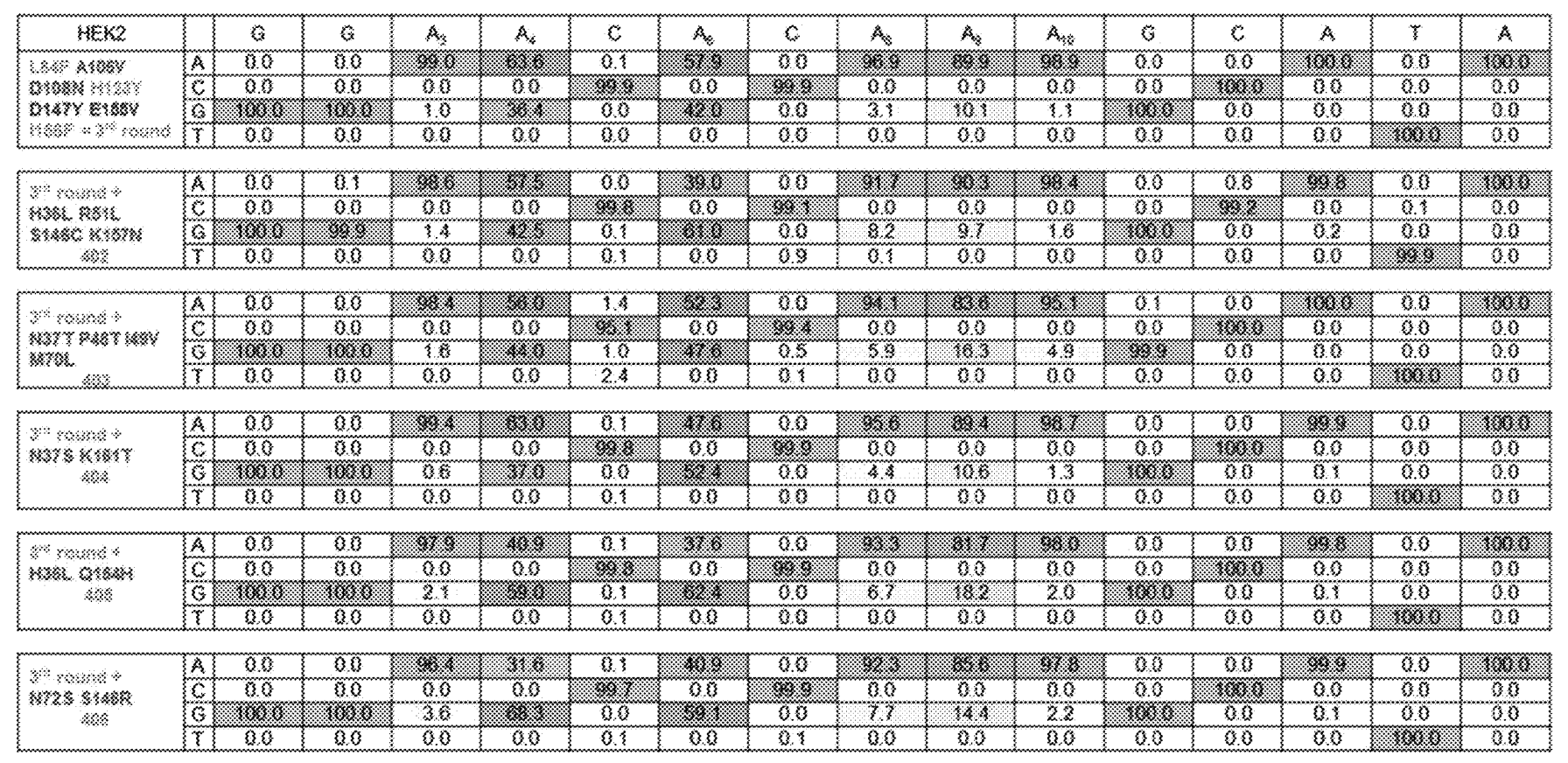

FIG. 176 shows editing results of various constructs for evolution 5.

Figure 177:
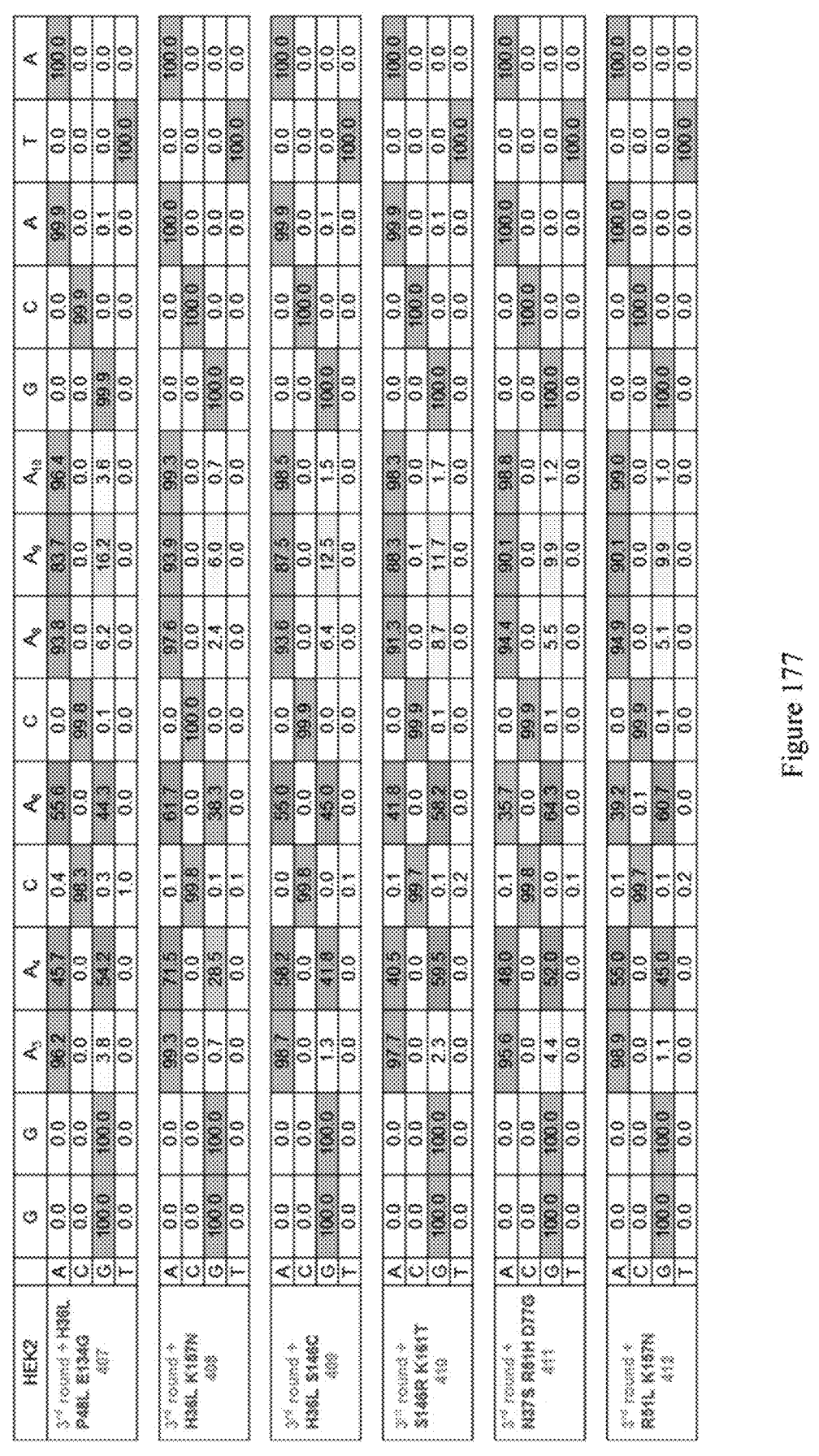

FIG. 177 shows editing results of various constructs for evolution 5.

FIG. 178 shows gRNAs for ABE. 5a constructs are characterized on all 16 NAN sequences A at position 5 in protospacer (left panel). The sequences correspond to SEQ ID NOs: 573-578 from top to bottom, respectively. Additional sequences starting with a "G" in order to minimize variations in yield gRNA synthesis are proposed (right panel). The sequences correspond to SEQ ID NOs: 579-588 from top to bottom, respectively.

Figure 179:
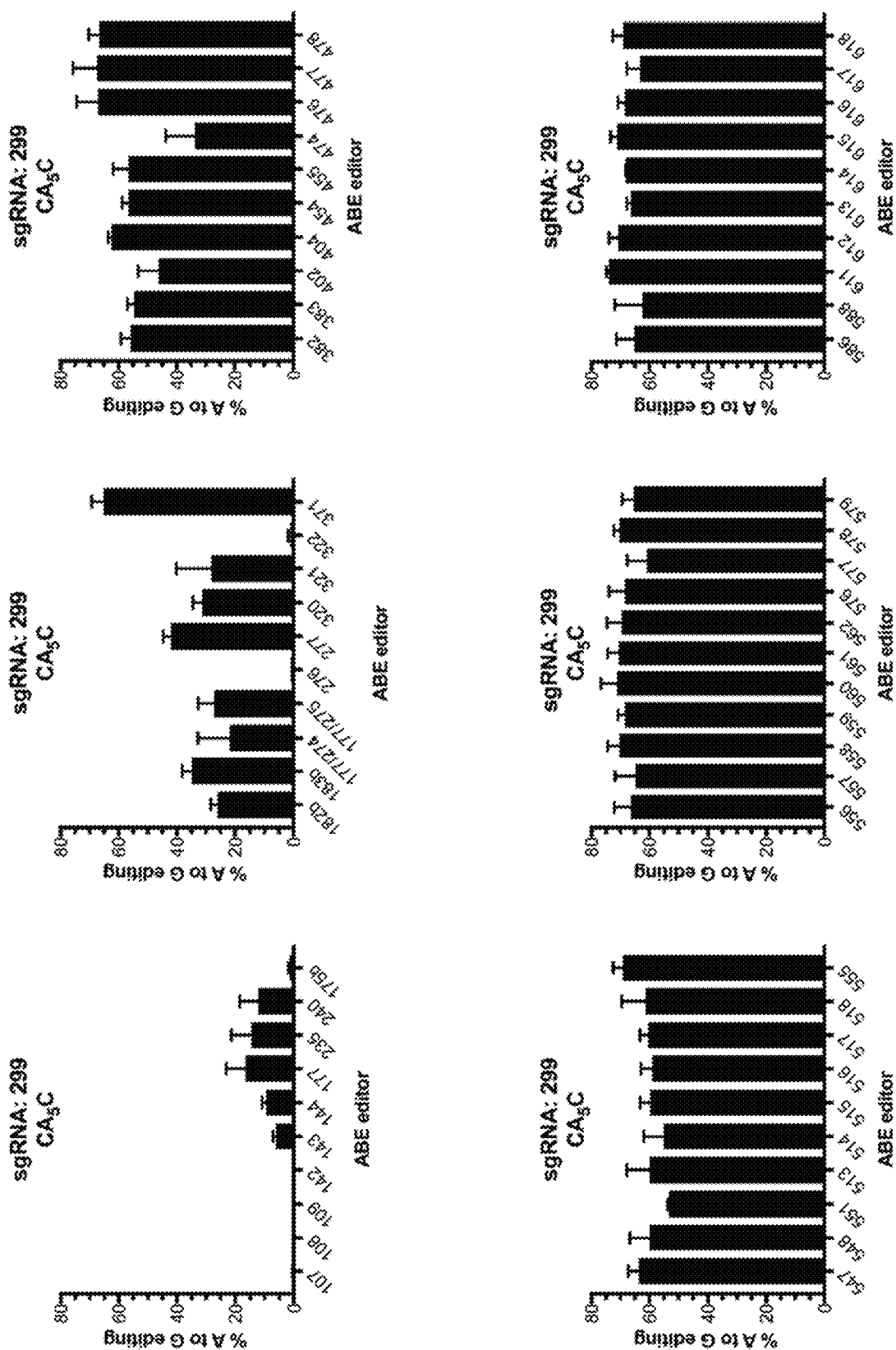

FIG. 179 shows % A to G editing of $A_5$ using sgRNA 299 as indicated in Table 8 and the ABE constructs, which are indicated by their pNMG reference numbers as shown in Table 4. The sequence corresponds to SEQ ID NO: 478.

Figure 180:
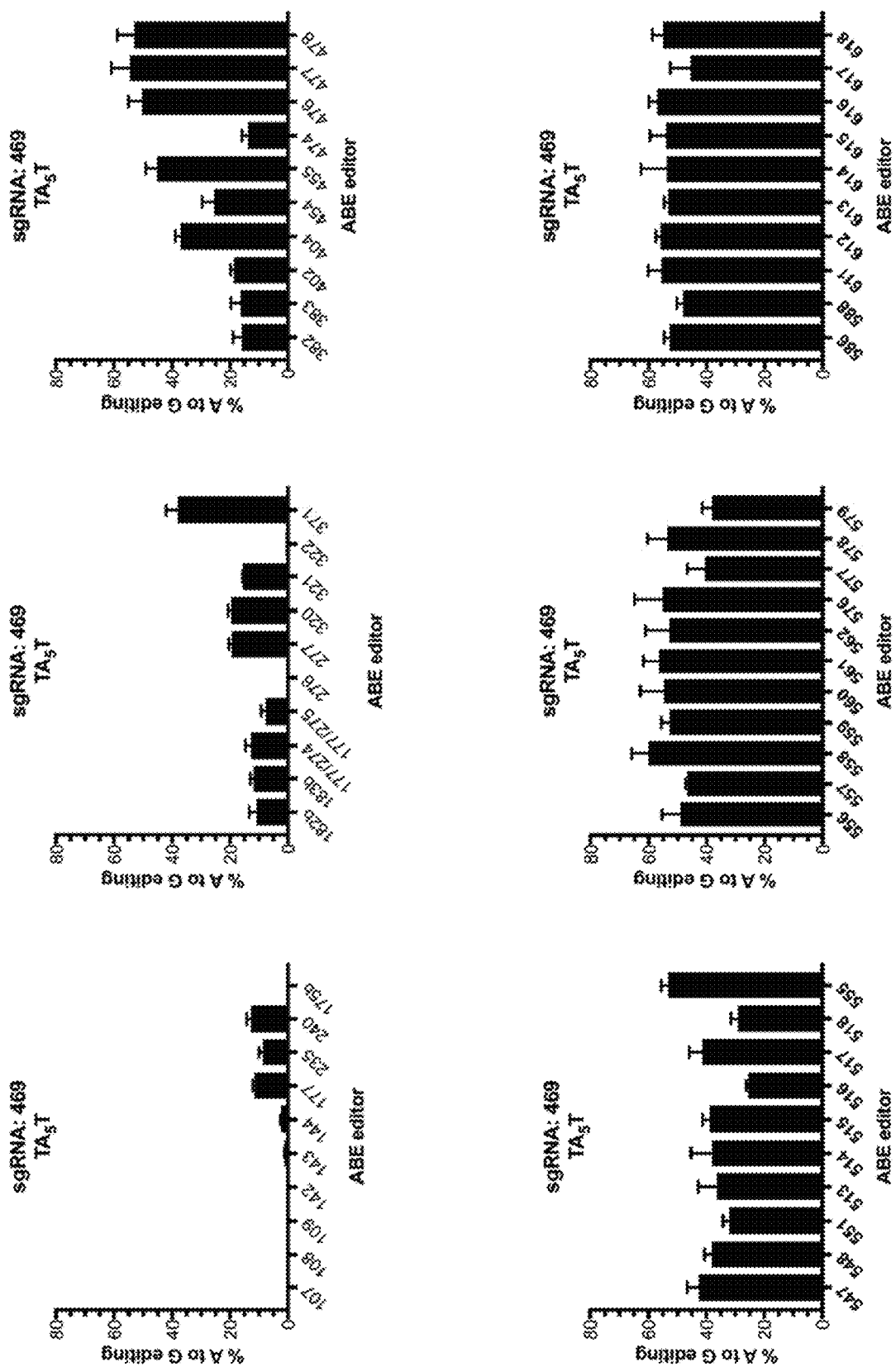

FIG. 180 shows % A to G editing of $A_5$ using sgRNA 469 as indicated in Table 8 and the ABE constructs, which are indicated by their pNMG reference numbers as shown in Table 4. The sequence corresponds to SEQ ID NO: 509.

Figure 181:
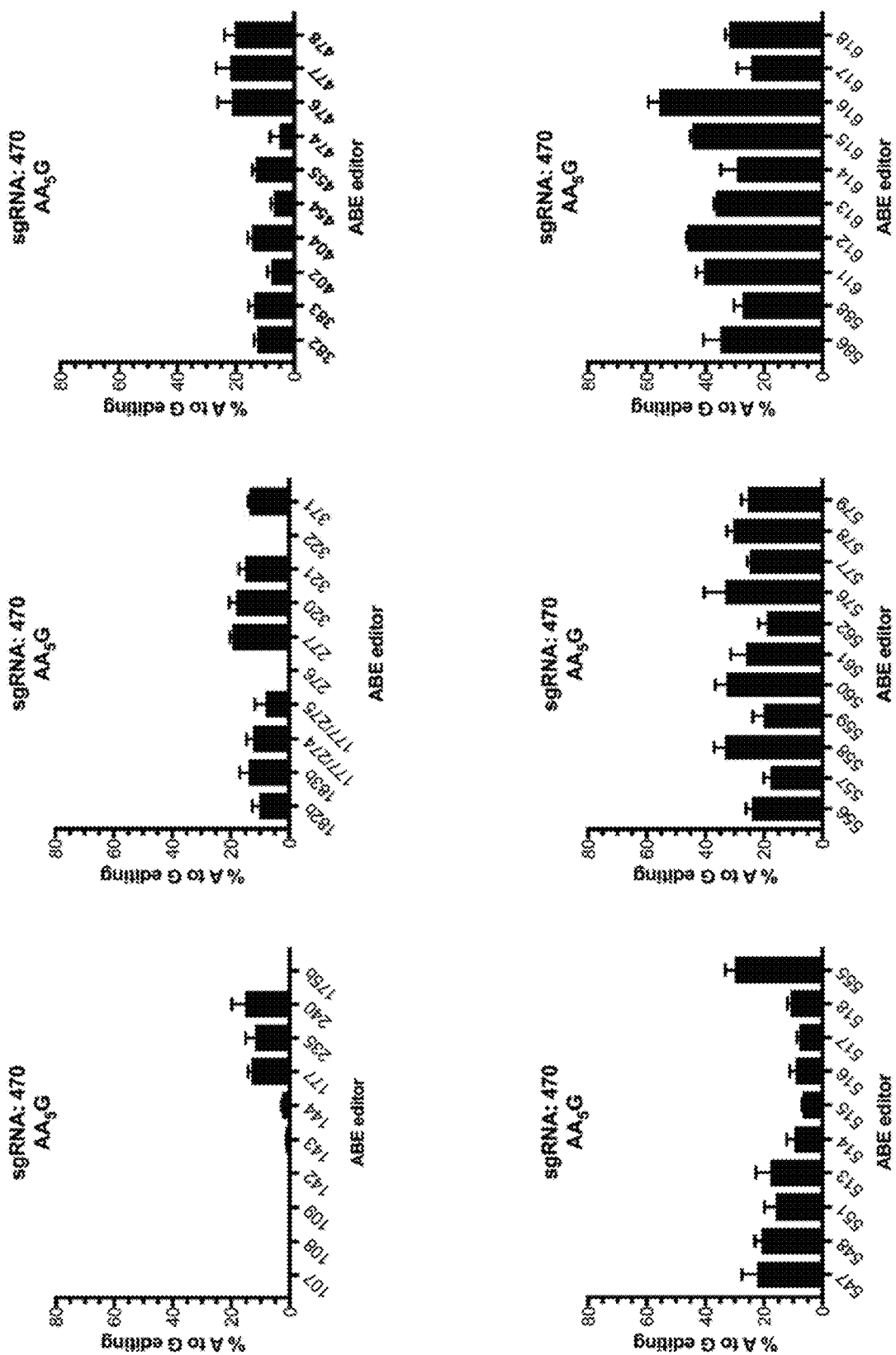

FIG. 181 shows % A to G editing of $A_5$ using sgRNA 470 as indicated in Table 8 and the ABE constructs, which are indicated by their pNMG reference numbers as shown in Table 4. The sequence corresponds to SEQ ID NO: 510.

Figure 182:
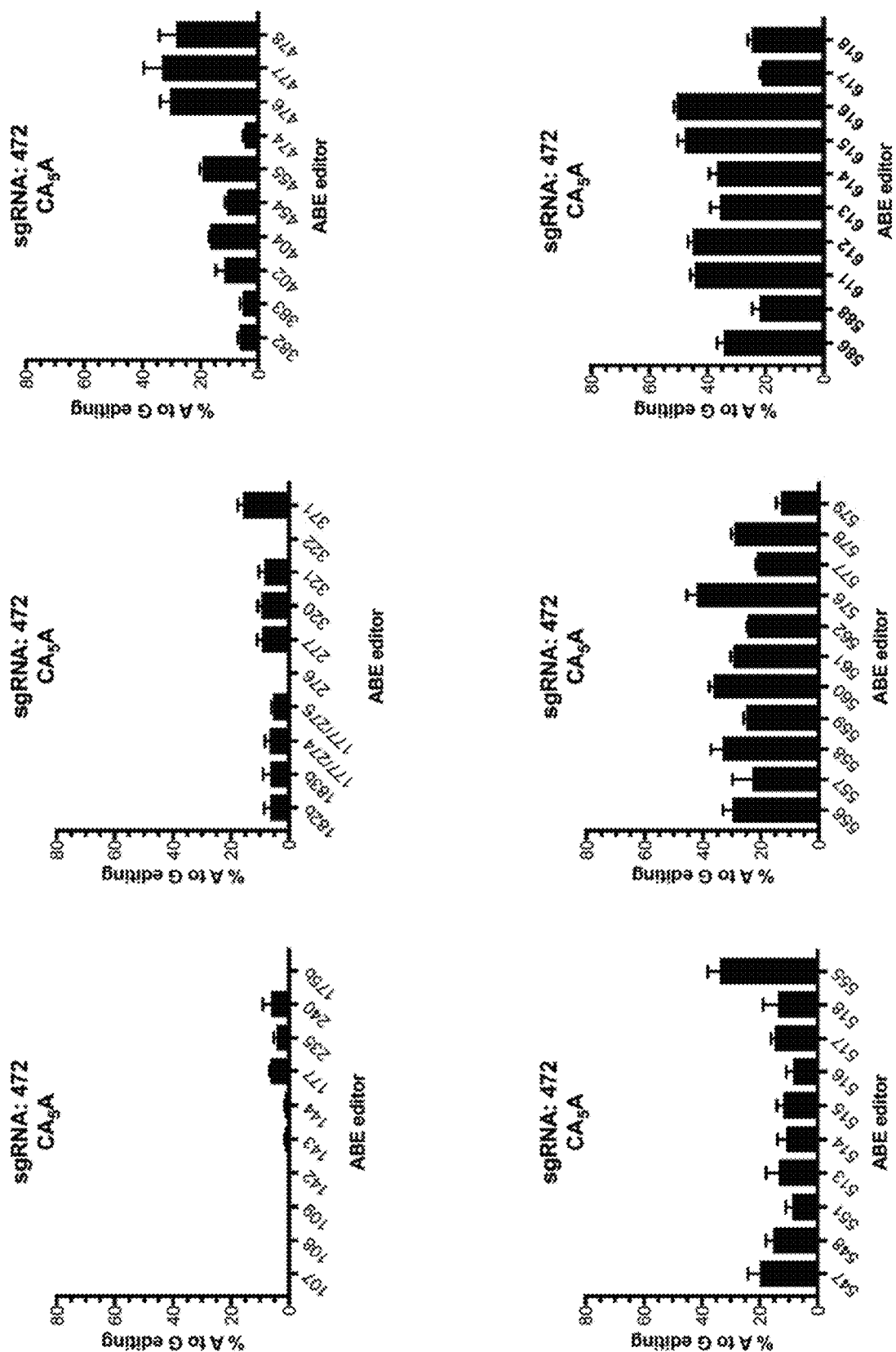

FIG. 182 shows % A to G editing of $A_5$ using sgRNA 472 as indicated in Table 8 and the ABE constructs, which are indicated by their pNMG reference numbers as shown in Table 4. The sequence corresponds to SEQ ID NO: 512.

Figure 183:
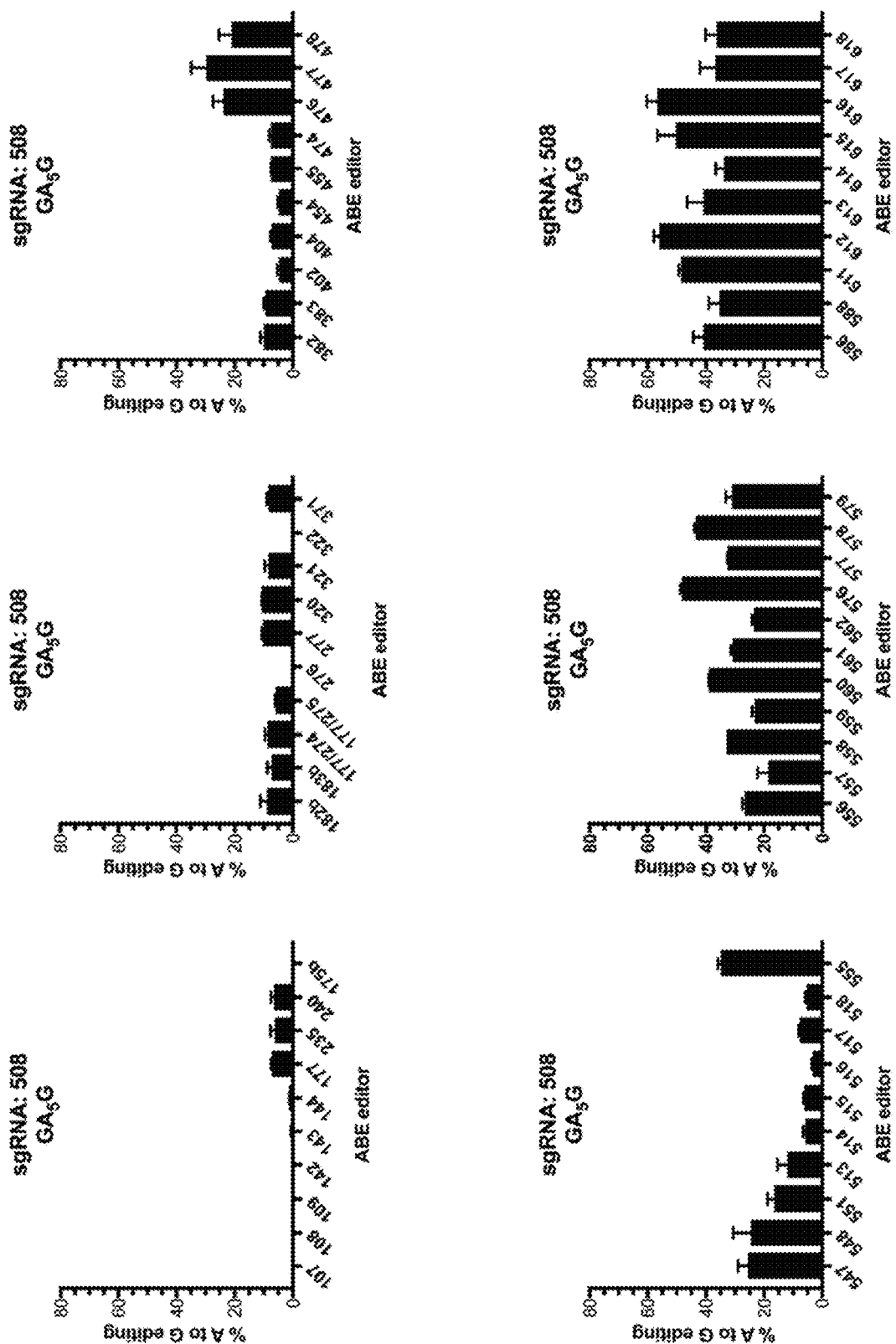

FIG. 183 shows % A to G editing of $A_5$ using sgRNA 508 as indicated in Table 8 and the ABE constructs, which are indicated by their pNMG reference numbers as shown in Table 4. The sequence corresponds to SEQ ID NO: 520.

Figure 184:
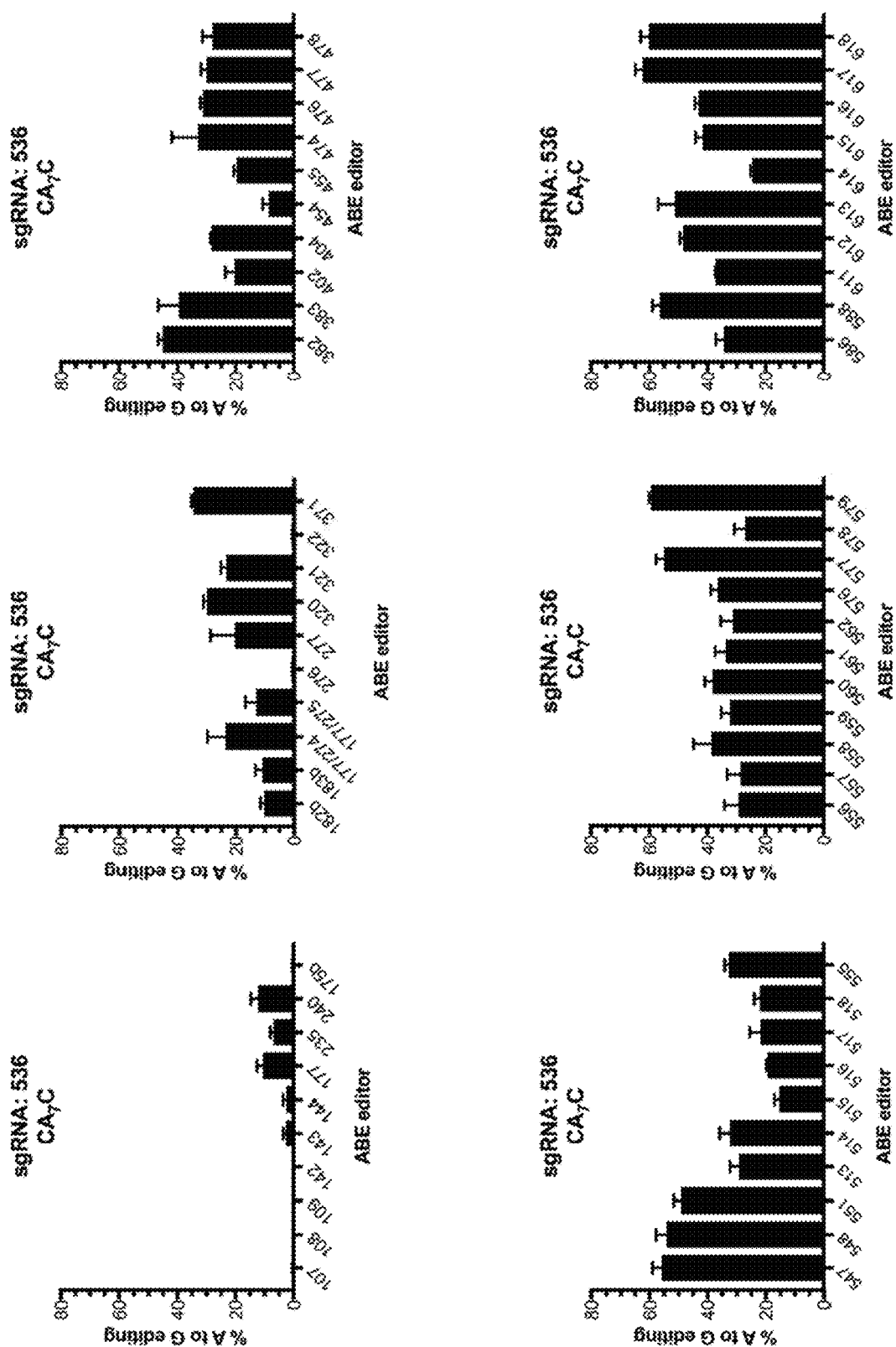

FIG. 184 shows % A to G editing of $A_7$ using sgRNA 536 as indicated in Table 8 and the ABE constructs, which are indicated by their pNMG reference numbers as shown in Table 4. The sequence corresponds to SEQ ID NO: 530.

Figure 185:
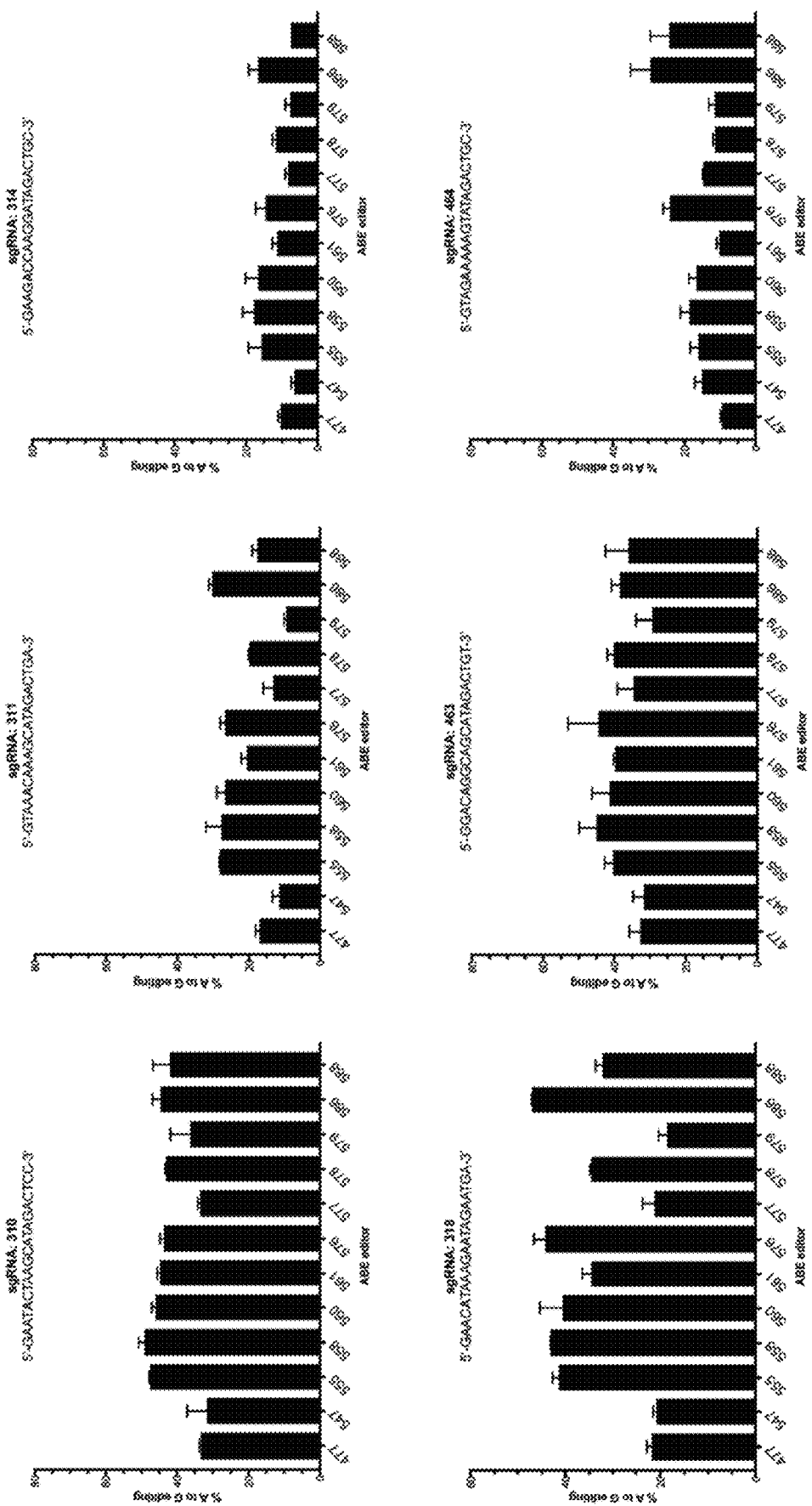

FIG. 185 shows the % of A to G editing of the highlighted A (As) using sgRNA: 310, sgRNA: 311, sgRNA: 314, sgRNA: 318, sgRNA: 463, and sgRNA: 464 for each of the indicated base editors, which are indicated by their pNMG reference numbers as shown in Table 4. The sequences correspond to SEQ ID NOs: 489, 490, 493, 497, 503 and 504 from left to right and top to bottom, respectively.

Figure 186:
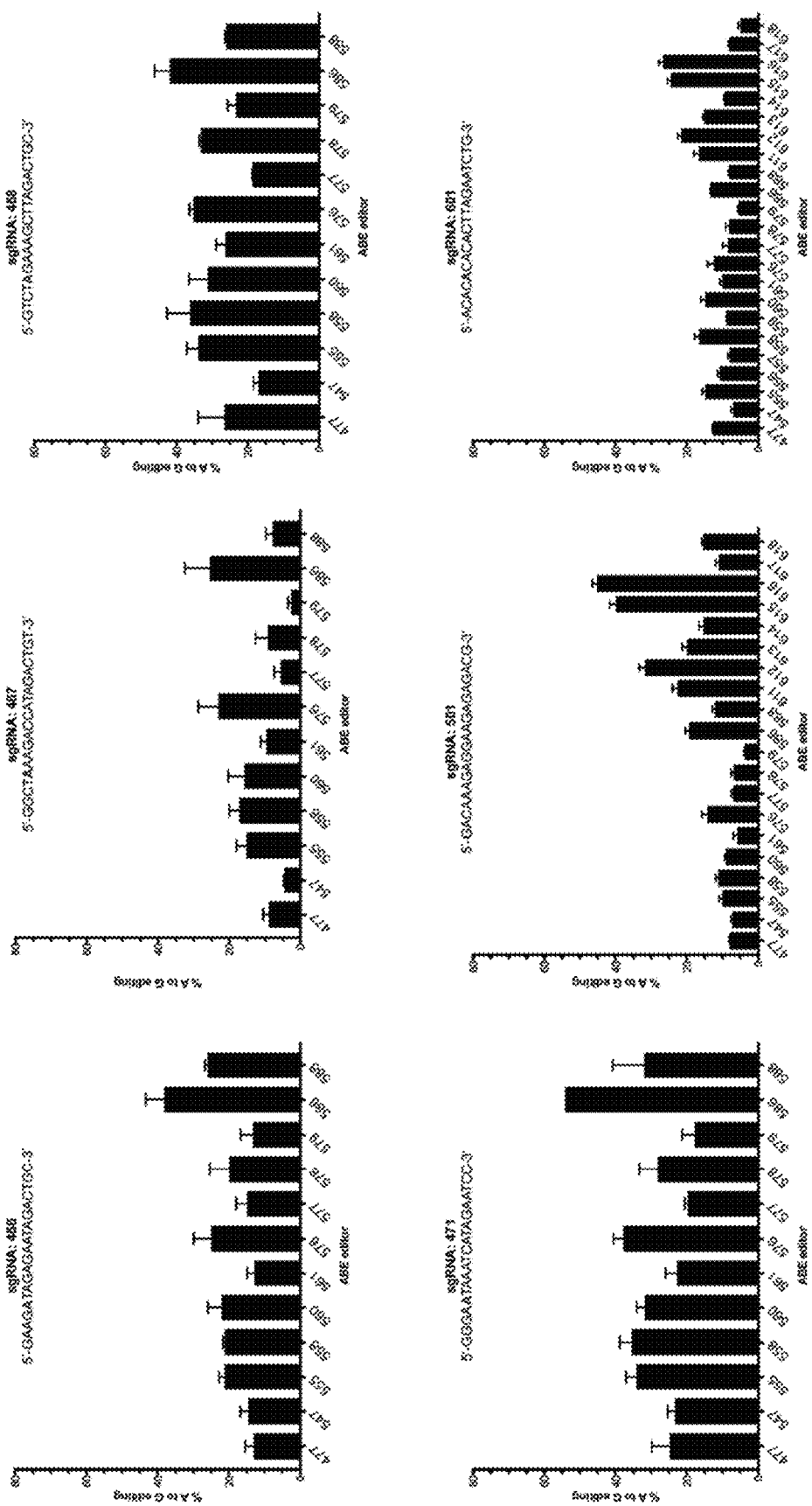

FIG. 186 shows the % of A to G editing of the highlighted A (As) using sgRNA: 466, sgRNA: 467, sgRNA: 468, sgRNA: 471, sgRNA: 501, and sgRNA: 601 for each of the indicated base editors, which are indicated by their pNMG reference numbers as shown in Table 4. The sequences correspond to SEQ ID NOs: 506, 507, 508, 511, 513, and 535 from left to right and top to bottom, respectively.

DEFINITIONS

As used herein and in the claims, the singular forms "a," "an," and "the" include the singular and the plural unless the context clearly indicates otherwise. Thus, for example, a reference to "an agent" includes a single agent and a plurality of such agents.

The term "deaminase" or "deaminase domain" refers to a protein or enzyme that catalyzes a deamination reaction. In some embodiments, the deaminase is an adenosine deaminase, which catalyzes the hydrolytic deamination of adenine or adenosine. In some embodiments, the deaminase or deaminase domain is an adenosine deaminase, catalyzing the hydrolytic deamination of adenosine or deoxyadenosine to inosine or deoxyinosine, respectively. In some embodiments, the adenosine deaminase catalyzes the hydrolytic deamination of adenine or adenosine in deoxyribonucleic acid (DNA). The adenosine deaminases (e.g. engineered adenosine deaminases, evolved adenosine deaminases) provided herein may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase. In some embodiments, the adenosine deaminase is from a bacterium, such as, E. coli, S. aureus, S. typhi, S. putrefaciens, H. influenzae, or C. crescentus. In some embodiments, the adenosine deaminase is a TadA deaminase. In some embodiments, the TadA deaminase is an E. coli TadA deaminase (ecTadA). In some embodiments, the TadA deaminase is a truncated E. coli TadA deaminase. For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine In some embodiments, the TadA deaminase is an N-terminal truncated TadA. In certain embodiments, the adenosine deaminase comprises the amino acid sequence:

```
                                         (SEQ ID NO: 1)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTD.
```

In some embodiments the TadA deaminase is a full-length E. coli TadA deaminase. For example, in certain embodiments, the adenosine deaminase comprises the amino acid sequence:

```
                                        (SEQ ID NO: 84)
MRRAFITGVFFLSEVEFSHEYWMRHALTLAKRAWDEREVPVGAVLVHNNR

VIGEGWNRPIGRHDPTAHAEIMALRQGGLVMQNYRLIDATLYVTLEPCVM
```

CAGAMIHSRIGRVVFGARDAKTGAAGSLMDVLHHPGMNHRVEITEGILAD

ECAALLSDFFRMRRQEIKAQKKAQSSTD

It should be appreciated, however, that additional adenosine deaminases useful in the present application would be apparent to the skilled artisan and are within the scope of this disclosure. For example, the adenosine deaminase may be a homolog of an ADAT. Exemplary ADAT homologs include, without limitation:

Staphylococcus aureus TadA:
(SEQ ID NO: 8)
MGSHMTNDIYFMTLAIEEAKKAAQLGEVPIGAIITKDDEVIARAHNLRET

LQQPTAHAEHIAIERAAKVLGSWRLEGCTLYVTLEPCVMCAGTIVMSRIP

RVVYGADDPKGGCSGSLMNLLQQSNFNHRAIVDKGVLKEACSTLLTTFFK

NLRANKKSTN

Bacillus subtilis TadA:
(SEQ ID NO: 9)
MTQDELYMKEAIKEAKKAEEKGEVPIGAVLVINGEIIARAHNLRETEQRS

IAHAEMLVID

EACKALGTWRLEGATLYVTLEPCPMCAGAVVLSRVEKVVFGAFDPKGGCS

GTLMNLLQEERFNHQAEVVSGVLEEECGGMLSAFFRELRKKKAARKNLS

E

Salmonella typhimurium (S. typhimurium) TadA:
(SEQ ID NO: 371)
MPPAFITGVTSLSDVELDHEYWMRHALTLAKRAWDEREVPVGAVLVHNHR

VIGEGWNRPIGRHDPTAHAEIMALRQGGLVLQNYRLLDTTLYVTLEPCVM

CAGAMVHSRIGRVVFGARDAKTGAAGSLIDVLHHPGMNHRVEIIEGVLRD

ECATLLSDFFRMRRQEIKALKKADRAEGAGPAV

Shewanella putrefaciens (S. putrefaciens) TadA:
(SEQ ID NO: 372)
MDEYWMQVAMQMAEKAEAAGEVPVGAVLVKDGQQIATGYNLSISQHDPTA

HAEILCLRSAGKKLENYRLLDATLYITLEPCAMCAGAMVHSRIARVVYGA

RDEKTGAAGTVVNLLQHPAFNHQVEVTSGVLAEACSAQLSRFFKRRRDEK

KALKLAQRAQQGIE

Haemophilus influenzae F3031 (H. influenzae) TadA:
(SEQ ID NO: 373)
MDAAKVRSEFDEKMMRYALELADKAEALGEIPVGAVLVDDARNIIGEGWN

LSIVQSDPTAHAEIIALRNGAKNIQNYRLLNSTLYVTLEPCTMCAGAILH

SRIKRLVFGASDYKTGAIGSRFHFFDDYKMNHTLEITSGVLAEECSQKLS

TFFQKRREEKKIEKALLKSLSDK

Caulobacter crescentus (C. crescentus) TadA:
(SEQ ID NO: 374)
MRTDESEDQDHRMMRLALDAARAAAEAGETPVGAVILDPSTGEVIATAGN

GPIAAHDPTAHAEIAAMRAAAAKLGNYRLTDLTLVVTLEPCAMCAGAISH

ARIGRVVFGADDPKGGAVVHGPKFFAQPTCHWRPEVTGGVLADESADLLR

GFFRARRKAKI

Geobacter sulfurreducens (G. sulfurreducens) TadA:
(SEQ ID NO: 375)
MSSLKKTPIRDDAYWMGKAIREAAKAAARDEVPIGAVIVRDGAVIGRGHN

LREGSNDPSAHAEMIAIRQAARRSANWRLTGATLYVTLEPCLMCMGAIIL

ARLERVVFGCYDPKGGAAGSLYDLSADPRLNHQVRLSPGVCQEECGTMLS

DFFRDLRRRKKAKATPALFIDERKVPPEP

The term "base editor (BE)," or "nucleobase editor (NBE)" refers to an agent comprising a polypeptide that is capable of making a modification to a base (e.g., A, T, C, G, or U) within a nucleic acid sequence (e.g., DNA or RNA). In some embodiments, the base editor is capable of deaminating a base within a nucleic acid. In some embodiments, the base editor is capable of deaminating a base within a DNA molecule. In some embodiments, the base editor is capable of deaminating an adenine (A) in DNA. In some embodiments, the base editor is a fusion protein comprising a nucleic acid programmable DNA binding protein (napDNAbp) fused to an adenosine deaminase. In some embodiments, the base editor is a Cas9 protein fused to an adenosine deaminase. In some embodiments, the base editor is a Cas9 nickase (nCas9) fused to an adenosine deaminase. In some embodiments, the base editor is a nuclease-inactive Cas9 (dCas9) fused to an adenosine deaminase. In some embodiments, the base editor is fused to an inhibitor of base excision repair, for example, a UGI domain, or a dISN domain. In some embodiments, the fusion protein comprises a Cas9 nickase fused to a deaminase and an inhibitor of base excision repair, such as a UGI or dISN domain. In some embodiments, the dCas9 domain of the fusion protein comprises a D10A and a H840A mutation of SEQ ID NO: 52, or a corresponding mutation in any of SEQ ID NOs: 108-357, which inactivates the nuclease activity of the Cas9 protein. In some embodiments, the fusion protein comprises a D10A mutation and comprises a histidine at residue 840 of SEQ ID NO: 52, or a corresponding mutation in any of SEQ ID NOs: 108-357, which renders Cas9 capable of cleaving only one strand of a nucleic acid duplex. An example of a Cas9 nickase is shown in SEQ ID NO: 35.

The term "linker," as used herein, refers to a bond (e.g., covalent bond), chemical group, or a molecule linking two molecules or moieties, e.g., two domains of a fusion protein, such as, for example, a nuclease-inactive Cas9 domain and a nucleic acid-editing domain (e.g., an adenosine deaminase). In some embodiments, a linker joins a gRNA binding domain of an RNA-programmable nuclease, including a Cas9 nuclease domain, and the catalytic domain of a nucleic-acid editing protein. In some embodiments, a linker joins a dCas9 and a nucleic-acid editing protein. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated. In some embodiments, a linker comprises the amino acid sequence SGSETPGTSESATPES (SEQ ID NO: 10), which may also be referred to as the XTEN linker. In some embodiments, a linker comprises the amino acid sequence SGGS (SEQ ID NO: 37). In some embodiments, a linker comprises $(SGGS)_n$ (SEQ ID NO: 37), (GGGS)$_n$ (SEQ ID NO: 38), (GGGGS)$_n$ (SEQ ID NO: 39), (G)$_n$, (EAAAK)$_n$ (SEQ ID NO: 40), (GGS)$_n$, SGSETPGTSESATPES (SEQ ID NO: 10), or (XP)$_n$ motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* (4$^{th}$ ed., Cold Spring Harbor Laboratory Press, Cold Spring Harbor, N.Y. (2012)).

The term "inhibitor of base repair" or "IBR" refers to a protein that is capable of inhibiting the activity of a nucleic acid repair enzyme, for example a base excision repair enzyme. In some embodiments, the IBR is an inhibitor of inosine base excision repair. Exemplary inhibitors of base repair include inhibitors of APE1, Endo III, Endo IV, Endo V, Endo VIII, Fpg, hOGG1, hNEIL1, T7 EndoI, T4PDG, UDG, hSMUG1, and hAAG. In some embodiments, the IBR is an inhibitor of Endo V or hAAG. In some embodiments, the IBR is a catalytically inactive EndoV or a catalytically inactive hAAG.

The term "uracil glycosylase inhibitor" or "UGI," as used herein, refers to a protein that is capable of inhibiting a uracil-DNA glycosylase base-excision repair enzyme. In some embodiments, a UGI domain comprises a wild-type UGI or a UGI as set forth in SEQ ID NO: 3. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 3. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 3. In some embodiments, a UGI comprises an amino acid sequence homologous to the amino acid sequence set forth in SEQ ID NO: 3, or an amino acid sequence homologous to a fragment of the amino acid sequence set forth in SEQ ID NO: 3. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 3. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 3. In some embodiments, the UGI comprises the following amino acid sequence:

```
>sp|P14739|UNGI_BPPB2 Uracil-DNA glycosylase
inhibitor
                                  (SEQ ID NO: 3)
MTNLSDIIEKETGKQLVIQESILMLPEEVEEVIGNKPESDILVHTAYDES

TDENVMLLTSDAPEYKPWALVIQDSNGENKIKML.
```

The term "catalytically inactive inosine-specific nuclease," or "dead inosine-specific nuclease (dISN)," as used herein, refers to a protein that is capable of inhibiting an inosine-specific nuclease. Without wishing to be bound by any particular theory, catalytically inactive inosine glycosylases (e.g., alkyl adenine glycosylase [AAG]) will bind inosine, but will not create an abasic site or remove the inosine, thereby sterically blocking the newly-formed inosine moiety from DNA damage/repair mechanisms. In some embodiments, the catalytically inactive inosine-specific nuclease may be capable of binding an inosine in a nucleic acid but does not cleave the nucleic acid. Exemplary catalytically inactive inosine-specific nucleases include, without limitation, catalytically inactive alkyl adenosine glycosylase (AAG nuclease), for example, from a human, and catalytically inactive endonuclease V (EndoV nuclease), for example, from *E. coli*. In some embodiments, the catalytically inactive AAG nuclease comprises an E125Q mutation as shown in SEQ ID NO: 32, or a corresponding mutation in another AAG nuclease. In some embodiments, the catalytically inactive AAG nuclease comprises the amino acid sequence set forth in SEQ ID NO: 32. In some embodiments, the catalytically inactive EndoV nuclease comprises an D35A mutation as shown in SEQ ID NO 32, or a corresponding mutation in another EndoV nuclease. In some embodiments, the catalytically inactive EndoV nuclease comprises the amino acid sequence set forth in SEQ ID NO: 33. It should be appreciated that other catalytically inactive inosine-specific nucleases (dISNs) would be apparent to the skilled artisan and are within the scope of this disclosure.

```
Truncated AAG (H. sapiens) nuclease (E125Q);
mutated residue underlined in bold.
                                  (SEQ ID NO: 32)
KGHLTRLGLEFFDQPAVPLARAFLGQVLVRRLPNGTELRGRIVETQAY

LGPEDEAAHSRGGRQTPRNRGMFMKPGTLYVYIIYGMYFCMNISSQGDGA

CVLLRALEPLEGLETMRQLRSTLRKGTASRVLKDRELCSGPSKLCQALAI

NKSFDQRDLAQDEAVWLERGPLEPSEPAVVAAARVGVGHAGEWARKPLRF

YVRGSPWVSVVDRVAEQDTQA

EndoV nuclease (D35A); mutated residue underlined
in bold.
                                  (SEQ ID NO: 33)
DLASLRAQQIELASSVIREDRLDKDPPDLIAGAAVGFEQGGEVTRAAM

VLLKYPSLELVEYKVARIATTMPYIPGFLSFREYPALLAAWEMLSQKPDL

VFVDGHGISHPRRLGVASHFGLLVDVPTIGVAKKRLCGKFEPLSSEPGAL

APLMDKGEQLAWVWRSKARCNPLFIATGHRVSVDSALAWVQRCMKGYRLP

EPTRWADAVASERPAFVRYTANQP
```

The term "nuclear localization sequence" or "NLS" refers to an amino acid sequence that promotes import of a protein into the cell nucleus, for example, by nuclear transport. Nuclear localization sequences are known in the art and would be apparent to the skilled artisan. For example, NLS sequences are described in Plank et al., international PCT application, PCT/EP2000/011690, filed Nov. 23, 2000, published as WO/2001/038547 on May 31, 2001, the contents of which are incorporated herein by reference for their disclosure of exemplary nuclear localization sequences. In some embodiments, a NLS comprises the amino acid sequence PKKKRKV (SEQ ID NO: 4) or MDSLLMNRRKFLY-QFKNVRWAKGRRETYLC (SEQ ID NO: 5).

The term "nucleic acid programmable DNA binding protein" or "napDNAbp" refers to a protein that associates with a nucleic acid (e.g., DNA or RNA), such as a guide nuclic acid, that guides the napDNAbp to a specific nucleic acid sequence. For example, a Cas9 protein can associate with a guide RNA that guides the Cas9 protein to a specific DNA sequence that has complementary to the guide RNA. In some embodiments, the napDNAbp is a class 2 microbial CRISPR-Cas effector. In some embodiments, the napDNAbp is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, C2c1, C2c2, C2C3, and Argonaute. It should be appreciated, however, that nucleic acid programmable DNAbinding proteins also include nucleic acid programmable proteins that bind RNA. For example, the napDNAbp may be associated with a nucleic acid that guides the napDNAbp to an RNA. Other nucleic acid programmable DNA binding proteins are also within the scope of this disclosure, though they may not be specifically listed in this disclosure.

The term "Cas9" or "Cas9 domain" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. *Science* 337:816-821 (2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663 (2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607 (2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821 (2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

A nuclease-inactivated Cas9 protein may interchangeably be referred to as a "dCas9" protein (for nuclease-"dead" Cas9). Methods for generating a Cas9 protein (or a fragment thereof) having an inactive DNA cleavage domain are known (See, e.g., Jinek et al., *Science*. 337:816-821 (2012); Qi et al., "Repurposing CRISPR as an RNA-Guided Platform for Sequence-Specific Control of Gene Expression" (2013) *Cell*. 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821 (2012); Qi et al., *Cell*. 28; 152(5):1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or 1300 amino acids in length. In some embodiments, wild type Cas9 corresponds to Cas9 from *Streptococcus pyogenes* (NCBI Reference Sequence: NC_017053.1, SEQ ID NO: 47 (nucleotide); SEQ ID NO: 48 (amino acid)).

```
                                            (SEQ ID NO: 47)
ATGGATAAGAAATACTCAATAGGCTTAGATATCGGCACAAATAGCGTCGG

ATGGGCGGTGATCACTGATGATTATAAGGTTCCGTCTAAAAAGTTCAAGG

TTCTGGGAAATACAGACCGCCACAGTATCAAAAAAAATCTTATAGGGGCT

CTTTTATTTGGCAGTGGAGAGACAGCGGAAGCGACTCGTCTCAAACGGAC

AGCTCGTAGAAGGTATACACGTCGGAAGAATCGTATTTGTTATCTACAGG

AGATTTTTTCAAATGAGATGGCGAAAGTAGATGATAGTTTCTTTCATCGA

CTTGAAGAGTCTTTTTTGGTGGAAGAAGACAAGAAGCATGAACGTCATCC

TATTTTTGGAAATATAGTAGATGAAGTTGCTTATCATGAGAAATATCCAA

CTATCTATCATCTGCGAAAAAATTGGCAGATTCTACTGATAAAGCGGAT

TTGCGCTTAATCTATTTGGCCTTAGCGCATATGATTAAGTTTCGTGGTCA

TTTTTTGATTGAGGGAGATTTAAATCCTGATAATAGTGATGTGGACAAAC

TATTTATCCAGTTGGTACAAATCTACAATCAATTATTTGAAGAAAACCCT

ATTAACGCAAGTAGAGTAGATGCTAAAGCGATTCTTTCTGCACGATTGAG

TAAATCAAGACGATTAGAAAATCTCATTGCTCAGCTCCCCGGTGAGAAGA

GAAATGGCTTGTTTGGGAATCTCATTGCTTTGTCATTGGGATTGACCCCT

AATTTTAAATCAAATTTTGATTTGGCAGAAGATGCTAAATTACAGCTTTC

AAAAGATACTTACGATGATGATTTAGATAATTTATTGGCGCAAATTGGAG

ATCAATATGCTGATTTGTTTTGGCAGCTAAGAATTTATCAGATGCTATT

TTACTTTCAGATATCCTAAGAGTAAATAGTGAAATAACTAAGGCTCCCCT

ATCAGCTTCAATGATTAAGCGCTACGATGAACATCATCAAGACTTGACTC

TTTTAAAAGCTTTAGTTCGACAACAACTTCCAGAAAAGTATAAAGAAATC

TTTTTTGATCAATCAAAAAACGGATATGCAGGTTATATTGATGGGGAGC

TAGCCAAGAAGAATTTATAAATTTATCAAACCAATTTTAGAAAAAATGG

ATGGTACTGAGGAATTATTGGTGAAACTAAATCGTGAAGATTTGCTGCGC

AAGCAACGGACCTTTGACAACGGCTCTATTCCCCATCAAATTCACTTGGG

TGAGCTGCATGCTATTTTGAGAAGACAAGAAGACTTTTATCCATTTTTAA

AAGACAATCGTGAGAAGATTGAAAAAATCTTGACTTTTCGAATTCCTTAT

TATGTTGGTCCATTGGCGCGTGGCAATAGTCGTTTTGCATGGATGACTCG
```

```
-continued
GAAGTCTGAAGAAACAATTACCCCATGGAATTTTGAAGAAGTTGTCGATA

AAGGTGCTTCAGCTCAATCATTTATTGAACGCATGACAAACTTTGATAAA

AATCTTCCAAATGAAAAAGTACTACCAAAACATAGTTTGCTTTATGAGTA

TTTTACGGTTTATAACGAATTGACAAAGGTCAAATATGTTACTGAGGGAA

TGCGAAAACCAGCATTTCTTTCAGGTGAACAGAAGAAAGCCATTGTTGAT

TTACTCTTCAAAACAAATCGAAAAGTAACCGTTAAGCAATTAAAAGAAGA

TTATTTCAAAAAAATAGAATGTTTTGATAGTGTTGAAATTTCAGGAGTTG

AAGATAGATTTAATGCTTCATTAGGCGCCTACCATGATTTGCTAAAAATT

ATTAAAGATAAAGATTTTTTGGATAATGAAGAAAATGAAGATATCTTAGA

GGATATTGTTTTAACATTGACCTTATTTGAAGATAGGGGGATGATTGAGG

AAAGACTTAAAACATATGCTCACCTCTTTGATGATAAGGTGATGAAACAG

CTTAAACGTCGCCGTTATACTGGTTGGGGACGTTTGTCTCGAAAATTGAT

TAATGGTATTAGGGATAAGCAATCTGGCAAAACAATATTAGATTTTTGA

AATCAGATGGTTTTGCCAATCGCAATTTTATGCAGCTGATCCATGATGAT

AGTTTGACATTTAAAGAAGATATTCAAAAAGCACAGGTGTCTGGACAAGG

CCATAGTTTACATGAACAGATTGCTAACTTAGCTGGCAGTCCTGCTATTA

AAAAAGGTATTTTACAGACTGTAAAAATTGTTGATGAACTGGTCAAAGTA

ATGGGGCATAAGCCAGAAAATATCGTTATTGAAATGGCACGTGAAAATCA

GACAACTCAAAAGGGCCAGAAAAATTCGCGAGAGCGTATGAAACGAATCG

AAGAAGGTATCAAAGAATTAGGAAGTCAGATTCTTAAAGAGCATCCTGTT

GAAAATACTCAATTGCAAAATGAAAAGCTCTATCTCTATTATCTACAAAA

TGGAAGAGACATGTATGTGGACCAAGAATTAGATATTAATCGTTTAAGTG

ATTATGATGTCGATCACATTGTTCCACAAAGTTTCATTAAAGACGATTCA

ATAGACAATAAGGTACTAACGCGTTCTGATAAAAATCGTGGTAAATCGGA

TAACGTTCCAAGTGAAGAAGTAGTCAAAAAGATGAAAAACTATTGGAGAC

AACTTCTAAACGCCAAGTTAATCACTCAACGTAAGTTTGATAATTTAACG

AAAGCTGAACGTGGAGGTTTGAGTGAACTTGATAAAGCTGGTTTTATCAA

ACGCCAATTGGTTGAAACTCGCCAAATCACTAAGCATGTGGCACAAATTT

TGGATAGTCGCATGAATACTAAATACGATGAAAATGATAAACTTATTCGA

GAGGTTAAAGTGATTACCTTAAAATCTAAATTAGTTTCTGACTTCCGAAA

AGATTTCCAATTCTATAAAGTACGTGAGATTAACAATTACCATCATGCCC

ATGATGCGTATCTAAATGCCGTCGTTGGAACTGCTTTGATTAAGAAATAT

CCAAAACTTGAATCGGAGTTTGTCTATGGTGATTATAAAGTTTATGATGT

TCGTAAAATGATTGCTAAGTCTGAGCAAGAAATAGGCAAAGCAACCGCAA

AATATTTCTTTTACTCTAATATCATGAACTTCTTCAAACAGAAATTACA

CTTGCAAATGGAGAGATTCGCAAACGCCCTCTAATCGAAACTAATGGGGA

AACTGGAGAAATTGTCTGGGATAAAGGGCGAGATTTGCCACAGTGCGCA

AAGTATTGTCCATGCCCCAAGTCAATATTGTCAAGAAAACAGAAGTACAG

ACAGGCGGATTCTCCAAGGAGTCAATTTTACCAAAAAGAAATTCGGACAA

GCTTATTGCTCGTAAAAAAGACTGGGATCCAAAAAAATATGGTGGTTTTG
```

```
ATAGTCCAACGGTAGCTTATTCAGTCCTAGTGGTTGCTAAGGTGGAAAAA
GGGAAATCGAAGAAGTTAAAATCCGTTAAAGAGTTACTAGGGATCACAAT
TATGGAAAGAAGTTCCTTTGAAAAAAATCCGATTGACTTTTTAGAAGCTA
AAGGATATAAGGAAGTTAAAAAAGACTTAATCATTAAACTACCTAAATAT
AGTCTTTTTGAGTTAGAAAACGGTCGTAAACGGATGCTGGCTAGTGCCGG
AGAATTACAAAAAGGAAATGAGCTGGCTCTGCCAAGCAAATATGTGAATT
TTTTATATTTAGCTAGTCATTATGAAAGTTGAAGGGTAGTCCAGAAGAT
AACGAACAAAAACAATTGTTTGTGGAGCAGCATAAGCATTATTTAGATGA
GATTATTGAGCAAATCAGTGAATTTTCTAAGCGTGTTATTTTAGCAGATG
CCAATTTAGATAAAGTTCTTAGTGCATATAACAAACATAGAGACAAACCA
ATACGTGAACAAGCAGAAAATATTATTCATTTATTTACGTTGACGAATCT
TGGAGCTCCCGCTGCTTTTAAATATTTTGATACAACAATTGATCGTAAAC
GATATACGTCTACAAAAGAAGTTTTAGATGCCACTCTTATCCATCAATCC
ATCACTGGTCTTTATGAAACACGCATTGATTTGAGTCAGCTAGGAGGTGA
CTGA
```

```
                                        (SEQ ID NO: 48)
MDKKYSIGLDIGTNSVGWAVITDDYKVPSKKFKVLGNTDRHSIKKNLIGA
LLFGSGETAEATRLKRTARRRYTRRKNRICYLQEIFSNEMAKVDDSFFH
RLEESFLVEEDKKHERHPIFGNIVDEVAYHEKYPTIYHLRKKLADSTDK
ADLRLIYLALAHMIKFRGHFLIEGDLNPDNSDVDKLFIQLVQIYNQLFE
ENPINASRVDAKAILSARLSKSRRLENLIAQLPGEKRNGLFGNLIALSL
GLTPNFKSNFDLAEDAKLQLSKDTYDDDLDNLLAQIGDQYADLFLAAKN
LSDAILLSDILRVNSEITKAPLSASMIKRYDEHHQDLTLLKALVRQQLP
EKYKEIFFDQSKNGYAGYIDGGASQEEFYKFIKPILEKMDGTEELLVKL
NREDLLRKQRTFDNGSIPHQIHLGELHAILRRQEDFYPFLKDNREKIEK
ILTFRIPYYVGPLARGNSRFAWMTRKSEETITPWNFEEVVDKGASAQSF
IERMTNFDKNLPNEKVLPKHSLLYEYFTVYNELTKVKYVTEGMRKPAFL
SGEQKKAIVDLLFKTNRKVTVKQLKEDYFKKIECFDSVEISGVEDRFNA
SLGAYHDLLKIIKDKDFLDNEENEDILEDIVLTLTLFEDRGMIEERLKT
YAHLFDDKVMKQLKRRRYTGWGRLSRKLINGIRDKQSGKTILDFLKSDG
FANRNFMQLIHDDSLTFKEDIQKAQVSGQGHSLHEQIANLAGSPAIKKG
ILQTVKIVDELVKVMGHKPENIVIEMARENQTTQKGQKNSRERMKRIEE
GIKELGSQILKEHPVENTQLQNEKLYLYYLQNGRDMYVDQELDINRLS
DYDVDHIVPQSFIKDDSIDNKVLTRSDKNRGKSDNVPSEEVVKKMKNY
WRQLLNAKLITQRKFDNLTKAERGGLSELDKAGFIKRQLVETRQITKH
VAQILDSRMNTKYDENDKLIREVKVITLKSKLVSDFRKDFQFYKVREI
NNYHHAHDAYLNAVVGTALIKKYPKLESEFVYGDYKVYDVRKMIAKSE
QEIGKATAKYFFYSNIMNFFKTEITLANGEIRKRPLIETNGETGEIVW
DKGRDFATVRKVLSMPQVNIVKKTEVQTGGFSKESILPKRNSDKLIAR
KKDWDPKKYGGFDSPTVAYSVLVVAKVEKGKSKKLKSVKELLGITIME
RSSFEKNPIDFLEAKGYKEVKKDLIIKLPKYSLFELENGRKRMLASAG
ELQKGNELALPSKYVNFLYLASHYEKLKGSPEDNEQKQLFVEQHKHYL
DEIIEQISEFSKRVILADANLDKVLSAYNKHRDKPIREQAENIIHLFT
LTNLGAPAAFKYFDTTIDRKRYTSTKEVLDATLIHQSITGLYETRIDL
SQLGGD
```
(single underline: HNH domain; double underline: RuvC domain)

In some embodiments, wild type Cas9 corresponds to, or comprises SEQ ID NO:49 (nucleotide) and/or SEQ ID NO: 50 (amino acid):

```
                                        (SEQ ID NO: 49)
ATGGATAAAAAGTATTCTATTGGTTTAGACATCGGCACTAATTCCGTTGGATGGG
CTGTCATAACCGATGAATACAAAGTACCTTCAAAGAAATTTAAGGTGTTGGGGA
ACACAGACCGTCATTCGATTAAAAAGAATCTTATCGGTGCCCTCCTATTCGATAG
TGGCGAAACGGCAGAGGCGACTCGCCTGAAACGAACCGCTCGGAGAAGGTATAC
ACGTCGCAAGAACCGAATATGTTACTTACAAGAAATTTTTAGCAATGAGATGGCC
AAAGTTGACGATTCTTTCTTTCACCGTTTGGAAGAGTCCTTCCTTGTCGAAGAGG
ACAAGAAACATGAACGGCACCCCATCTTTGGAAACATAGTAGATGAGGTGGCAT
ATCATGAAAGTACCCAACGATTATCACCTCAGAAAAAGCTAGTTGACTCAA
CTGATAAAGCGGACCTGAGGTTAATCTACTTGGCTCTTGCCCATATGATAAAGTT
CCGTGGGCACTTTCTCATTGAGGGTGATCTAAATCCGGACAACTCGGATGTCGAC
AAACTGTTCATCCAGTTAGTACAAACCTATAATCAGTTGTTTGAAGAGAACCCTA
TAAATGCAAGTGGCGTGGATGCGAAGGCTATTCTTAGCGCCCGCCTCTCTAAATC
CCGACGGCTAGAAAACCTGATCGCACAATTACCCGGAGAGAAGAAAAATGGGTT
GTTCGGTAACCTTATAGCGCTCTCACTAGGCCTGACACCAAATTTTAAGTCGAAC
TTCGACTTAGCTGAAGATGCCAAATTGCAGCTTAGTAAGGACACGTACGATGAC
```

-continued

```
GATCTCGACAATCTACTGGCACAAATTGGAGATCAGTATGCGGACTTATTTTTGG

CTGCCAAAAACCTTAGCGATGCAATCCTCCTATCTGACATACTGAGAGTTAATAC

TGAGATTACCAAGGCGCCGTTATCCGCTTCAATGATCAAAAGGTACGATGAACAT

CACCAAGACTTGACACTTCTCAAGGCCCTAGTCCGTCAGCAACTGCCTGAGAAAT

ATAAGGAAATATTCTTTGATCAGTCGAAAAACGGGTACGCAGGTTATATTGACG

GCGGAGCGAGTCAAGAGGAATTCTACAAGTTTATCAAACCCATATTAGAGAAGA

TGGATGGGACGGAAGAGTTGCTTGTAAAACTCAATCGCGAAGATCTACTGCGAA

AGCAGCGGACTTTCGACAACGGTAGCATTCCACATCAAATCCACTTAGGCGAATT

GCATGCTATACTTAGAAGGCAGGAGGATTTTTATCCGTTCCTCAAAGACAATCGT

GAAAAGATTGAGAAAATCCTAACCTTTCGCATACCTTACTATGTGGGACCCCTGG

CCCGAGGGAACTCTCGGTTCGCATGGATGACAAGAAAGTCCGAAGAAACGATTA

CTCCATGGAATTTTGAGGAAGTTGTCGATAAAGGTGCGTCAGCTCAATCGTTCAT

CGAGAGGATGACCAACTTTGACAAGAATTTACCGAACGAAAAGTATTGCCTAA

GCACAGTTTACTTTACGAGTATTTCACAGTGTACAATGAACTCACGAAAGTTAAG

TATGTCACTGAGGGCATGCGTAAACCCGCCTTTCTAAGCGGAGAACAGAAGAAA

GCAATAGTAGATCTGTTATTCAAGACCAACCGCAAAGTGACAGTTAAGCAATTG

AAAGAGGACTACTTTAAGAAAATTGAATGCTTCGATTCTGTCGAGATCTCCGGGG

TAGAAGATCGATTTAATGCGTCACTTGGTACGTATCATGACCTCCTAAAGATAAT

TAAAGATAAGGACTTCCTGGATAACGAAGAGAATGAAGATATCTTAGAAGATAT

AGTGTTGACTCTTACCCTCTTTGAAGATCGGGAAATGATTGAGGAAAGACTAAAA

ACATACGCTCACCTGTTCGACGATAAGGTTATGAAACAGTTAAAGAGGCGTCGCT

ATACGGGCTGGGGACGATTGTCGCGGAAACTTATCAACGGGATAAGAGACAAGC

AAAGTGGTAAAACTATTCTCGATTTTCTAAAGAGCGACGGCTTCGCCAATAGGAA

CTTTATGCAGCTGATCCATGATGACTCTTTAACCTTCAAAGAGGATATACAAAAG

GCACAGGTTTCCGGACAAGGGGACTCATTGCACGAACATATTGCGAATCTTGCTG

GTTCGCCAGCCATCAAAAAGGGCATACTCCAGACAGTCAAAGTAGTGGATGAGC

TAGTTAAGGTCATGGGACGTCACAAACCGGAAAACATTGTAATCGAGATGGCAC

GCGAAAATCAAACGACTCAGAAGGGGCAAAAAAACAGTCGAGAGCGGATGAAG

AGAATAGAAGAGGGTATTAAAGAACTGGGCAGCCAGATCTTAAAGGAGCATCCT

GTGGAAAATACCCAATTGCAGAACGAGAAACTTTACCTCTATTACCTACAAAATG

GAAGGGACATGTATGTTGATCAGGAACTGGACATAAACCGTTTATCTGATTACGA

CGTCGATCACATTGTACCCCAATCCTTTTTGAAGGACGATTCAATCGACAATAAA

GTGCTTACACGCTCGGATAAGAACCGAGGGAAAAGTGACAATGTTCCAAGCGAG

GAAGTCGTAAAGAAAATGAAGAACTATTGGCGGCAGCTCCTAAATGCGAAACTG

ATAACGCAAAGAAAGTTCGATAACTTAACTAAAGCTGAGAGGGGTGGCTTGTCT

GAACTTGACAAGGCCGGATTTATTAAACGTCAGCTCGTGGAAACCCGCCAAATC

ACAAAGCATGTTGCACAGATACTAGATTCCCGAATGAATACGAAATACGACGAG

AACGATAAGCTGATTCGGGAAGTCAAAGTAATCACTTTAAAGTCAAAATTGGTG

TCGGACTTCAGAAAGGATTTTCAATTCTATAAAGTTAGGGAGATAAATAACTACC

ACCATGCGCACGACGCTTATCTTAATGCCGTCGTAGGGACCGCACTCATTAAGAA
```

-continued

```
ATACCCGAAGCTAGAAAGTGAGTTTGTGTATGGTGATTACAAAGTTTATGACGTC

CGTAAGATGATCGCGAAAAGCGAACAGGAGATAGGCAAGGCTACAGCCAAATA

CTTCTTTTATTCTAACATTATGAATTTCTTTAAGACGGAAATCACTCTGGCAAACG

GAGAGATACGCAAACGACCTTTAATTGAAACCAATGGGGAGACAGGTGAAATCG

TATGGGATAAGGGCCGGGACTTCGCGACGGTGAGAAAAGTTTTGTCCATGCCCC

AAGTCAACATAGTAAAGAAAACTGAGGTGCAGACCGGAGGGTTTTCAAAGGAAT

CGATTCTTCCAAAAAGGAATAGTGATAAGCTCATCGCTCGTAAAAAGGACTGGG

ACCCGAAAAAGTACGGTGGCTTCGATAGCCCTACAGTTGCCTATTCTGTCCTAGT

AGTGGCAAAAGTTGAGAAGGGAAAATCCAAGAAACTGAAGTCAGTCAAAGAAT

TATTGGGGATAACGATTATGGAGCGCTCGTCTTTTGAAAAGAACCCCATCGACTT

CCTTGAGGCGAAAGGTTACAAGGAAGTAAAAAAGGATCTCATAATTAAACTACC

AAAGTATAGTCTGTTTGAGTTAGAAAATGGCCGAAAACGGATGTTGGCTAGCGC

CGGAGAGCTTCAAAAGGGGAACGAACTCGCACTACCGTCTAAATACGTGAATTT

CCTGTATTTAGCGTCCCATTACGAGAAGTTGAAAGGTTCACCTGAAGATAACGAA

CAGAAGCAACTTTTTGTTGAGCAGCACAAACATTATCTCGACGAAATCATAGAGC

AAATTTCGGAATTCAGTAAGAGAGTCATCCTAGCTGATGCCAATCTGGACAAAGT

ATTAAGCGCATACAACAAGCACAGGGATAAACCCATACGTGAGCAGGCGGAAA

ATATTATCCATTTGTTTACTCTTACCAACCTCGGCGCTCCAGCCGCATTCAAGTAT

TTTGACACAACGATAGATCGCAAACGATACACTTCTACCAAGGAGGTGCTAGAC

GCGACACTGATTCACCAATCCATCACGGGATTATATGAAACTCGGATAGATTTGT

CACAGCTTGGGGGTGACGGATCCCCCAAGAAGAAGAGGAAAGTCTCGAGCGACT

ACAAAGACCATGACGGTGATTATAAAGATCATGACATCGATTACAAGGATGACG

ATGACAAGGCTGCAGGA
```

(SEQ ID NO: 50)
MDKK<u>YSIGLAIGTNSVGWAVITDEYKVPSKKFKVLGNTDRHSIKKNLIGALLFDSGE</u>

<u>T</u>AEATRLKRTARRRYTRRKNRICYLQEIFSNEMAKVDDSFFHRLEESFLVEEDKKHE

RHPIFGNIVDEVAYHEKYPTIYHLRKKLVDSTDKADLRLIYLALAHMIKFRGHFLIEG

DLNPDNSDVDKLFIQLVQTYNQLFEENPINASGVDAKAILSARLSKSRRLENLIAQLP

GEKKNGLFGNLIALSLGLTPNFKSNFDLAEDAKLQLSKDTYDDDLDNLLAQIGDQYA

DLFLAAKNLSDAILLSDILRVNTEITKAPLSASMIKRYDEHHQDLTLLKALVRQQLPE

KYKEIFFDQSKNGYAGYIDGGASQEEFYKFIKPILEKMDGTEELLVKLNREDLLRKQR

TFDNGSIPHQIHLGELHAILRRQEDFYPFLKDNREKIEKILTFRIPYYVGPLARGNSRFA

WMTRKSEETITPWNFEEVVDKGASAQSFIERMTNFDKNLPNEKVLPKHSLLYEYFTV

YNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERL

KTYAHLFDDKVMKQLKRRRYTGWGRLSRKLINGIRDKQSGKTILDFLKSDGFANRN

FMQLIHDDSLTFKEDIQKAQVSGQG<u>DSLHEHIANLAGSPAIKKGILQTVKVVDELVK</u>

<u>VMGRHKPENIVIEMARENQTTQK</u>G<u>QKNSRERMKRIEEGIKELGSQILKEHPVENTQL</u>

<u>QNEKLYYLQNGRDMYVDQELDINRLSDYDVDHIVPQSFLKDDSIDNKVLTRSDK</u>

<u>NRGKSDNVPSEEVVKKMKNYWRQLLNAKLITQRKFDNLTKAERG</u>G<u>LSELDKAGFIK</u>

<u>RQLVETRQITKHVAQILDSRMNTKYDENDKLIREVKVITLKSKLVSDFRKDFQFYKV</u>

-continued

<u>REINNYHHAHDAYLNAVVGTALIKKYPKLESEFVYGDYKVYDVRKMIAKSEQEIGK</u>

<u>ATAKYFFYSNIMNFFKTEITLANGEIRKRPLIETNGETGEIVWDKGRDFATVRKVLSM</u>

<u>PQVNIVKKTEVQ</u>TGGFSKESILPKRNSDKLIARKKDWDPKKYGGFDSPTVAYSVLVV

AKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGD
(single underline: HNH domain; double underline: RuvC domain)

In some embodiments, wild type Cas9 corresponds to Cas9 from *Streptococcus pyogenes* (NCBI Reference Sequence: NC_002737.2, SEQ ID NO: 51 (nucleotide); and Uniport Reference Sequence: Q99ZW2, SEQ ID NO: 52 (amino acid).

```
                                             (SEQ ID NO: 51)
ATGGATAAGAAATACTCAATAGGCTTAGATATCGGCACAAATAGCGTCGGATGG

GCGGTGATCACTGATGAATATAAGGTTCCGTCTAAAAAGTTCAAGGTTCTGGGAA

ATACAGACCGCCACAGTATCAAAAAAAATCTTATAGGGGCTCTTTTATTTGACAG

TGGAGAGACAGCGGAAGCGACTCGTCTCAAACGGACAGCTCGTAGAAGGTATAC

ACGTCGGAAGAATCGTATTTGTTATCTACAGGAGATTTTTTCAAATGAGATGGCG

AAAGTAGATGATAGTTTCTTTCATCGACTTGAAGAGTCTTTTTTGGTGGAAGAAG

ACAAGAAGCATGAACGTCATCCTATTTTTGGAAATATAGTAGATGAAGTTGCTTA

TCATGAGAAATATCCAACTATCTATCATCTGCGAAAAAAATTGGTAGATTCTACT

GATAAAGCGGATTTGCGCTTAATCTATTTGGCCTTAGCGCATATGATTAAGTTTC

GTGGTCATTTTTTGATTGAGGGAGATTTAAATCCTGATAATAGTGATGTGGACAA

ACTATTTATCCAGTTGGTACAAACCTACAATCAATTATTTGAAGAAACCCTATT

AACGCAAGTGGAGTAGATGCTAAAGCGATTCTTTCTGCACGATTGAGTAAATCA

AGACGATTAGAAAATCTCATTGCTCAGCTCCCCGGTGAGAAGAAAATGGCTTA

TTTGGGAATCTCATTGCTTTGTCATTGGGTTTGACCCCTAATTTTAAATCAAATTT

TGATTTGGCAGAAGATGCTAAATTACAGCTTTCAAAAGATACTTACGATGATGAT

TTAGATAATTTATTGGCGCAAATTGGAGATCAATATGCTGATTTGTTTTTGGCAG

CTAAGAATTTATCAGATGCTATTTTACTTTCAGATATCCTAAGAGTAAATACTGA

AATAACTAAGGCTCCCCTATCAGCTTCAATGATTAAACGCTACGATGAACATCAT

CAAGACTTGACTCTTTTAAAAGCTTTAGTTCGACAACAACTTCCAGAAAAGTATA

AAGAAATCTTTTTTGATCAATCAAAAAACGGATATGCAGGTTATATTGATGGGGG

AGCTAGCCAAGAAGAATTTTATAAATTTATCAAACCAATTTTAGAAAAAATGGAT

GGTACTGAGGAATTATTGGTGAAACTAAATCGTGAAGATTTGCTGCGCAAGCAA

CGGACCTTTGACAACGGCTCTATTCCCCATCAAATTCACTTGGGTGAGCTGCATG

CTATTTTGAGAAGACAAGAAGACTTTTATCCATTTTTAAAAGACAATCGTGAGAA

GATTGAAAAAATCTTGACTTTTCGAATTCCTTATTATGTTGGTCCATTGGCGCGTG

GCAATAGTCGTTTTGCATGGATGACTCGGAAGTCTGAAGAAACAATTACCCCATG

GAATTTTGAAGAAGTTGTCGATAAAGGTGCTTCAGCTCAATCATTTATTGAACGC

ATGACAAACTTTGATAAAAATCTTCCAAATGAAAAAGTACTACCAAAACATAGT
```

-continued

```
TTGCTTTATGAGTATTTTACGGTTTATAACGAATTGACAAAGGTCAAATATGTTA

CTGAAGGAATGCGAAAACCAGCATTTCTTTCAGGTGAACAGAAGAAAGCCATTG

TTGATTTACTCTTCAAAACAAATCGAAAAGTAACCGTTAAGCAATTAAAAGAAG

ATTATTTCAAAAAAATAGAATGTTTTGATAGTGTTGAAATTTCAGGAGTTGAAGA

TAGATTTAATGCTTCATTAGGTACCTACCATGATTTGCTAAAAATTATTAAAGAT

AAAGATTTTTTGGATAATGAAGAAAATGAAGATATCTTAGAGGATATTGTTTTAA

CATTGACCTTATTTGAAGATAGGGAGATGATTGAGGAAAGACTTAAAACATATG

CTCACCTCTTTGATGATAAGGTGATGAAACAGCTTAAACGTCGCCGTTATACTGG

TTGGGGACGTTTGTCTCGAAAATTGATTAATGGTATTAGGGATAAGCAATCTGGC

AAAACAATATTAGATTTTTTGAAATCAGATGGTTTTGCCAATCGCAATTTTATGC

AGCTGATCCATGATGATAGTTTGACATTTAAAGAAGACATTCAAAAAGCACAAG

TGTCTGGACAAGGCGATAGTTTACATGAACATATTGCAAATTTAGCTGGTAGCCC

TGCTATTAAAAAAGGTATTTTACAGACTGTAAAAGTTGTTGATGAATTGGTCAAA

GTAATGGGGCGGCATAAGCCAGAAAATATCGTTATTGAAATGGCACGTGAAAAT

CAGACAACTCAAAAGGGCCAGAAAAATTCGCGAGAGCGTATGAAACGAATCGA

AGAAGGTATCAAAGAATTAGGAAGTCAGATTCTTAAAGAGCATCCTGTTGAAAA

TACTCAATTGCAAAATGAAAAGCTCTATCTCTATTATCTCCAAAATGGAAGAGAC

ATGTATGTGGACCAAGAATTAGATATTAATCGTTTAAGTGATTATGATGTCGATC

ACATTGTTCCACAAAGTTTCCTTAAAGACGATTCAATAGACAATAAGGTCTTAAC

GCGTTCTGATAAAAATCGTGGTAAATCGGATAACGTTCCAAGTGAAGAAGTAGT

CAAAAAGATGAAAAACTATTGGAGACAACTTCTAAACGCCAAGTTAATCACTCA

ACGTAAGTTTGATAATTTAACGAAAGCTGAACGTGGAGGTTTGAGTGAACTTGAT

AAAGCTGGTTTTATCAAACGCCAATTGGTTGAAACTCGCCAAATCACTAAGCATG

TGGCACAAATTTTGGATAGTCGCATGAATACTAAATACGATGAAAATGATAAAC

TTATTCGAGAGGTTAAAGTGATTACCTTAAAATCTAAATTAGTTTCTGACTTCCG

AAAAGATTTCCAATTCTATAAAGTACGTGAGATTAACAATTACCATCATGCCCAT

GATGCGTATCTAAATGCCGTCGTTGGAACTGCTTTGATTAAGAAATATCCAAAAC

TTGAATCGGAGTTTGTCTATGGTGATTATAAAGTTTATGATGTTCGTAAAATGATT

GCTAAGTCTGAGCAAGAAATAGGCAAAGCAACCGCAAAATATTTCTTTTACTCTA

ATATCATGAACTTCTTCAAAACAGAAATTACACTTGCAAATGGAGAGATTCGCAA

ACGCCCTCTAATCGAAACTAATGGGGAAACTGGAGAAATTGTCTGGGATAAAGG

GCGAGATTTTGCCACAGTGCGCAAAGTATTGTCCATGCCCCAAGTCAATATTGTC

AAGAAAACAGAAGTACAGACAGGCGGATTCTCCAAGGAGTCAATTTTACCAAAA

AGAAATTCGGACAAGCTTATTGCTCGTAAAAAAGACTGGGATCCAAAAAAATAT

GGTGGTTTTGATAGTCCAACGGTAGCTTATTCAGTCCTAGTGGTTGCTAAGGTGG

AAAAAGGGAAATCGAAGAAGTTAAAATCCGTTAAAGAGTTACTAGGGATCACAA

TTATGGAAAGAAGTTCCTTTGAAAAAAATCCGATTGACTTTTTAGAAGCTAAAGG

ATATAAGGAAGTTAAAAAAGACTTAATCATTAAACTACCTAAATATAGTCTTTTT

GAGTTAGAAAACGGTCGTAAACGGATGCTGGCTAGTGCCGGAGAATTACAAAAA

GGAAATGAGCTGGCTCTGCCAAGCAAATATGTGAATTTTTTATATTTAGCTAGTC
```

```
-continued
ATTATGAAAAGTTGAAGGGTAGTCCAGAAGATAACGAACAAAAACAATTGTTTG

TGGAGCAGCATAAGCATTATTTAGATGAGATTATTGAGCAAATCAGTGAATTTTC

TAAGCGTGTTATTTTAGCAGATGCCAATTTAGATAAAGTTCTTAGTGCATATAAC

AAACATAGAGACAAACCAATACGTGAACAAGCAGAAAATATTATTCATTTATTT

ACGTTGACGAATCTTGGAGCTCCCGCTGCTTTTAAATATTTTGATACAACAATTG

ATCGTAAACGATATACGTCTACAAAAGAAGTTTTAGATGCCACTCTTATCCATCA

ATCCATCACTGGTCTTTATGAAACACGCATTGATTTGAGTCAGCTAGGAGGTGAC

TGA
                                             (SEQ ID NO: 52)
MDKKYSIGLDIGTNSVGWAVITDEYKVPSKKFKVLGNTDRHSIKKNLIGALLFDSGE

TAEATRLKRTARRRYTRRKNRICYLQEIFSNEMAKVDDSFFHRLEESFLVEEDKKHE

RHPIFGNIVDEVAYHEKYPTIYHLRKKLVDSTDKADLRLIYLALAHMIKFRGHFLIEG

DLNPDNSDVDKLFIQLVQTYNQLFEENPINASGVDAKAILSARLSKSRRLENLIAQLP

GEKKNGLFGNLIALSLGLTPNFKSNFDLAEDAKLQLSKDTYDDDLDNLLAQIGDQYA

DLFLAAKNLSDAILLSDILRVNTEITKAPLSASMIKRYDEHHQDLTLLKALVRQQLPE

KYKEIFFDQSKNGYAGYIDGGASQEEFYKFIKPILEKMDGTEELLVKLNREDLLRKQR

TFDNGSIPHQIHLGELHAILRRQEDFYPFLKDNREKIEKILTFRIPYYVGPLARGNSRFA

WMTRKSEETITPWNFEEVVDKGASAQSFIERMTNFDKNLPNEKVLPKHSLLYEYFTV

YNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERL

KTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSEQEIGK

ATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVV

AKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGD
(single underline: HNH domain; double underline: RuvC domain)
```

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria. meningitidis* (NCBI Ref: YP_002342100.1) or to a Cas9 from any other organism.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation of SEQ ID NO: 52 or corresponding mutations in another Cas9. In some embodiments, the dCas9 comprises the amino acid sequence of SEQ ID NO: 53 dCas9 (D10A and H840A):

(SEQ ID NO: 53)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKA

DLRLIYLALAHMIKFRGHFLIEGDLNPDNSDVDKLFIQLVQTYNQLFEE

NPINASGVDAKAILSARLSKSRRLENLIAQLPGEKKNGLFGNLIALSLG

LTPNFKSNFDLAEDAKLQLSKDTYDDDLDNLLAQIGDQYADLFLAAKNL

SDAILLSDILRVNTEITKAPLSASMIKRYDEHHQDLTLLKALVRQQLPE

KYKEIFFDQSKNGYAGYIDGGASQEEFYKFIKPILEKMDGTEELLVKLN

REDLLRKQRTFDNGSIPHQIHLGELHAILRRQEDFYPFLKDNREKIEKI

LTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNAS

LGTYHDLLKIIKDKDFLDNEENEDILEDIVLTLTLFEDREMIEERLKTY

AHLFDDKVMKQLKRRRYTGWGRLSRKLINGIRDKQSGKTILDFLKSDGF

ANRNFMQLIHDDSLTFKEDIQKAQVSGQG<u>DSLHEHIANLAGSPAIKKGI</u>

<u>LQTVKVVDELVKVMGRHKPENIVIEMARENQTTQKGQKNSRERMKRIE</u>

<u>EGIKELGSQILKEHPVENTQLQNEKLYLYYLQNGRDMYVDQELDINRL</u>

<u>SDYDVDAIVPQSFLKDDSIDNKVLTRSDKNRGKSDNVPSEEVVKKMKN</u>

<u>YWRQLLNAKLITQRKFDNLTKAERGGLSELDKAGFIKRQLVETRQITK</u>

<u>HVAQILDSRMNTKYDENDKLIREVKVITLKSKLVSDFRKDFQFYKVRE</u>

<u>INNYHHAHDAYLNAVVGTALIKKYPKLESEFVYGDYKVYDVRKMIAKS</u>

<u>EQEIGKATAKYFFYSNIMNFFKTEITLANGEIRKRPLIETNGETGEIV</u>

<u>WDKGRDFATVRKVLSMPQVNIVKKTE</u>VQTGGFSKESILPKRNSDKLIA

RKKDWDPKKYGGFDSPTVAYSVLVVAKVEKGKSKKLKSVKELLGITIME

RSSFEKNPIDFLEAKGYKEVKKDLIIKLPKYSLFELENGRKRMLASAGE

LQKGNELALPSKYVNFLYLASHYEKLKGSPEDNEQKQLFVEQHKHYLDE

IIEQISEFSKRVILADANLDKVLSAYNKHRDKPIREQAENIIHLFTLTN

LGAPAAFKYFDTTIDRKRYTSTKEVLDATLIHQSITGLYETRIDLSQLG

GD
(single underline: HNH domain; double underline: RuvC domain).

Figure 94:
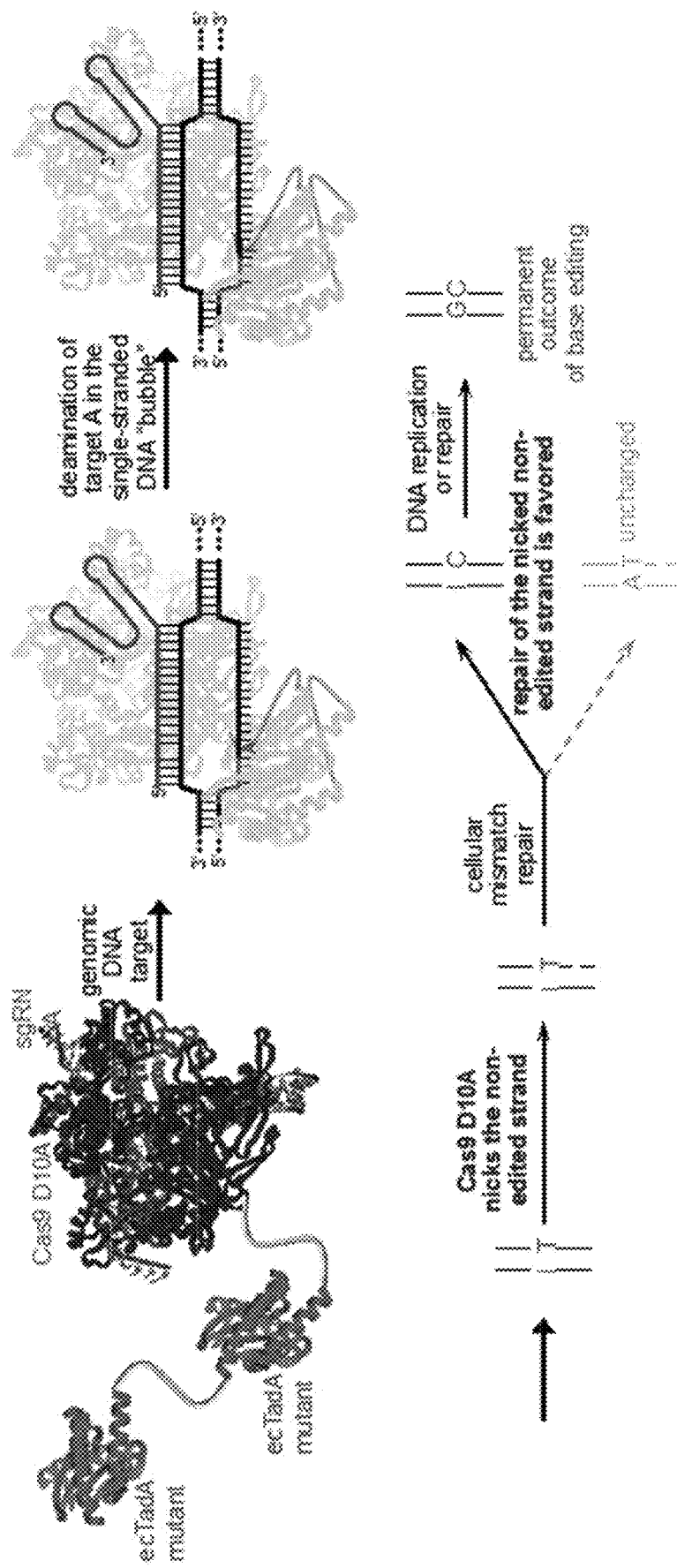
FIG. 94 shows a schematic representation of an exemplary adenosine base editing process.
Figure 95:
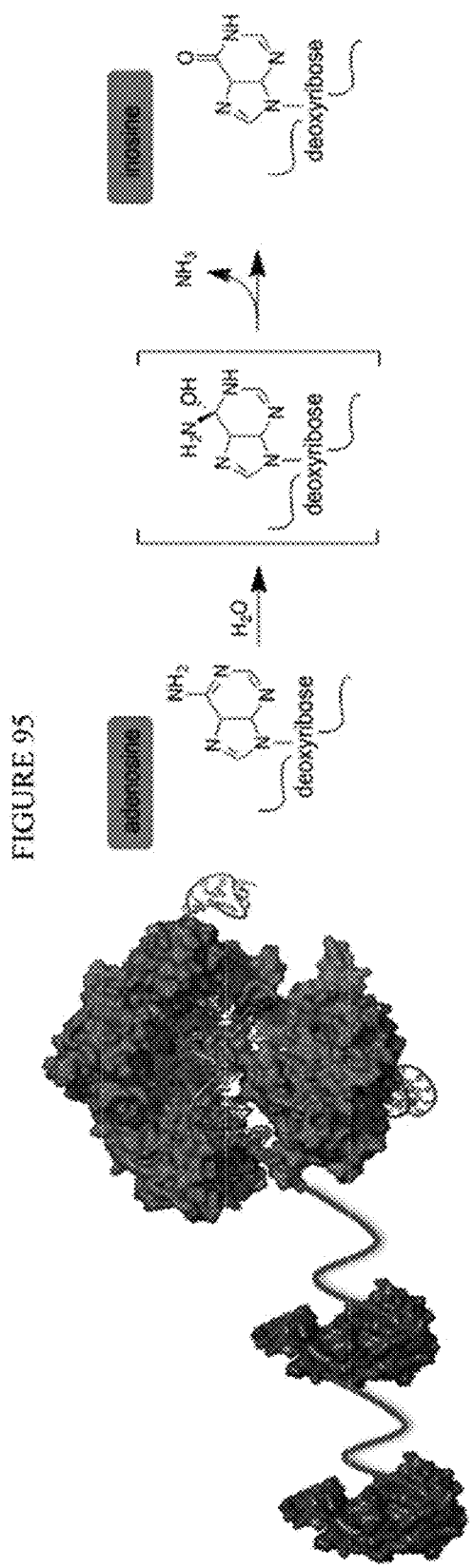
FIG. 95 shows a schematic representation of an exemplary adenosine base editor, which deaminates adenosine to inosine.

In some embodiments, the Cas9 domain comprises a D10A mutation, while the residue at position 840 remains a histidine in the amino acid sequence provided in SEQ ID NO: 52, or at corresponding positions in any of the amino acid sequences provided in SEQ ID NOs: 108-357. Without wishing to be bound by any particular theory, the presence of the catalytic residue H840 maintains the activity of the Cas9 to cleave the non-edited (e.g., non-deaminated) strand containing a T opposite the targeted A. Restoration of H840 (e.g., from A840 of a dCas9) does not result in the cleavage of the target strand containing the A. Such Cas9 variants are able to generate a single-strand DNA break (nick) at a specific location based on the gRNA-defined target sequence, leading to repair of the non-edited strand, ultimately resulting in a T to C change on the non-edited strand. A schematic representation of this process is shown in FIG. 94. Briefly, and without wishing to be bound by any particular theory, the A of a A-T base pair can be deaminated to a inosine (I) by an adenosine deaminase, e.g., an engineered adenosine deaminase that deaminates an adenosine in DNA. Nicking the non-edited strand, having the T, facilitates removal of the T via mismatch repair mechanisms. A UGI domain or a catalytically inactive inosine-specific nuclease (dISN) may inhibit inosine-specific nucleases (e.g., sterically) thereby preventing removal of the inosine (I).

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 (e.g., variants of SEQ ID NO: 53) are provided which are at least about 70% identical, at least about 80% identical, at least about 90% identical, at least about 95% identical, at least about 98% identical, at least about 99% identical, at least about 99.5% identical, or at least about 99.9% identical to SEQ ID NO: 10. In some embodiments, variants of dCas9 (e.g., variants of SEQ ID NO: 53) are provided having amino acid sequences which are shorter, or longer than SEQ ID NO: 53, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only a fragment thereof. For example, in some embodiments, a Cas9 fusion protein provided herein comprises a Cas9 fragment, wherein the fragment binds crRNA and tracrRNA or sgRNA, but does not comprise a functional nuclease domain, e.g., in that it comprises only a truncated version of a nuclease domain or no nuclease domain at all.

Exemplary amino acid sequences of suitable Cas9 domains and Cas9 fragments are provided herein, and additional suitable sequences of Cas9 domains and fragments will be apparent to those of skill in the art.

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1).

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the dCas9 comprises the amino acid sequence (SEQ ID NO: 34). In some embodiments, the Cas9 protein is a Cas9 nickase (nCas9). In some embodiments, the nCas9 comprises the amino acid sequence (SEQ ID NO: 35). In some embodiments, the Cas9 protein is a nuclease active Cas9. In some embodiments, the nuclease active Cas9 comprises the amino acid sequence (SEQ ID NO: 36).

Exemplary catalytically inactive Cas9 (dCas9):
(SEQ ID NO: 34)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDAIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary Cas9 nickase (nCas9):
(SEQ ID NO: 35)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary catalytically active Cas9:
(SEQ ID NO: 36)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

-continued

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD.

In some embodiments, Cas9 refers to a Cas9 from arehaea (e.g. nanoarchaea), which constitute a domain and kingdom of single-celled prokaryotic microbes. In some embodiments, Cas9 refers to CasX or CasY, which have been described in, for example, Burstein et al., "New CRISPR-Cas systems from uncultivated microbes." *Cell Res.* 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp), and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 417-419. In some embodiments, the napDNAbp comprises an amino acid sequence of any one SEQ ID NOs: 417-419. It should be appreciated that CasX and CasY from other bacterial species may also be used in accordance with the present disclosure.

CasX (uniprot.org/uniprot/F0NN87; uniprot.org/uniprot/F0NH53)
>tr|F0NN87|F0NN87_SULIH CRISPR-associated Casx
protein OS = *Sulfolobus islandicus*
(strain HVE10/4) GN = SiH_0402 PE = 4 SV = 1

(SEQ ID NO: 417)
MEVPLYNIFGDNYIIQVATEAENSTIYNNKVEIDDEELRNVLNLAYKIAK

NNEDAAAERRGKAKKKKGEEGETTTSNIILPLSGNDKNPWTETLKCYNFP

TTVALSEVFKNFSQVKECEEVSAPSFVKPEFYEFGRSPGMVERTRRVKLE

VEPHYLIIAAAGWVLTRLGKAKVSEGDYVGVNVFTPTRGILYSLIQNVNG

IVPGIKPETAFGLWIARKVVSSVTNPNVSVVRIYTISDAVGQNPTTINGG

FSIDLTKLLEKRYLLSERLEAIARNALSISSNMRERYIVLANYIYEYLTG

SKRLEDLLYFANRDLIMNLNSDDGKVRDLKLISAYVNGELIRGEG

>tr|F0NH53|F0NH53_SULIR CRISPR associated protein,
Casx OS = *Sulfolobus islandicus*
(strain REY15A) GN = SiRe_0771 PE = 4 SV = 1
(SEQ ID NO: 418)
MEVPLYNIFGDNYIIQVATEAENSTIYNNKVEIDDEELRNVLNLAYKIAK

NNEDAAAERRGKAKKKKGEEGETTTSNIILPLSGNDKNPWTETLKCYNFP

TTVALSEVFKNFSQVKECEEVSAPSFVKPEFYKFGRSPGMVERTRRVKLE

VEPHYLIMAAAGWVLTRLGKAKVSEGDYVGVNVFTPTRGILYSLIQNVNG

IVPGIKPETAFGLWIARKVVSSVTNPNVSVVSIYTISDAVGQNPTTINGG

FSIDLTKLLEKRDLLSERLEAIARNALSISSNMRERYIVLANYIYEYLTG

SKRLEDLLYFANRDLIMNLNSDDGKVRDLKLISAYVNGELIRGEG

CasY (ncbi.nlm.nih.gov/protein/APG80656.1)
>APG80656.1 CRISPR-associated protein CasY
[uncultured Parcubacteria group bacterium]
(SEQ ID NO: 419)
MSKRHPRISGVKGYRLHAQRLEYTGKSGAMRTIKYPLYSSPSGGRTVPRE

IVSAINDDYVGLYGLSNFDDLYNAEKRNEEKVYSVLDFWYDCVQYGAVFS

YTAPGLLKNVAEVRGGSYELTKTLKGSHLYDELQIDKVIKFLNKKEISRA

NGSLDKLKKDIIDCFKAEYRERHKDQCNKLADDIKNAKKDAGASLGERQK

KLFRDFFGISEQSENDKPSFTNPLNLTCCLLPFDTVNNNRNRGEVLFNKL

KEYAQKLDKNEGSLEMWEYIGIGNSGTAFSNFLGEGFLGRLRENKITELK

KAMMDITDAWRGQEQEEELEKRLRILAALTIKLREPKFDNHWGGYRSDIN

GKLSSWLQNYINQTVKIKEDLKGHKKDLKKAKEMINRFGESDTKEEAVVS

SLLESIEKIVPDDSADDEKPDIPAIAIYRRFLSDGRLTLNRFVQREDVQE

ALIKERLEAEKKKKPKKRKKKSDAEDEKETIDFKELFPHLAKPLKLVPNF

YGDSKRELYKKYKNAAIYTDALWKAVEKIYKSAFSSSLKNSFFDTDFDKD

FFIKRLQKIFSVYRRFNTDKWKPIVKNSFAPYCDIVSLAENEVLYKPKQS

RSRKSAAIDKNRVRLPSTENIAKAGIALARELSVAGFDWKDLLKKEEHEE

YIDLIELHKTALALLLAVTETQLDISALDFVENGTVKDFMKTRDGNLVLE

GRFLEMFSQSIVFSELRGLAGLMSRKEFITRSAIQTMNGKQAELLYIPHE

FQSAKITTPKEMSRAFLDLAPAEFATSLEPESLSEKSLLKLKQMRYYPHY

FGYELTRTGQGIDGGVAENALRLEKSPVKKREIKCKQYKTLGRGQNKIVL

YVRSSYYQTQFLEWFLHRPKNVQTDVAVSGSFLIDEKKVKTRWNYDALTV

ALEPVSGSERVFVSQPFTIFPEKSAEEEGQRYLGIDIGEYGIAYTALEIT

GDSAKILDQNFISDPQLKTLREEVKGLKLDQRRGTFAMPSTKIARIRESL

VHSLRNRIHHLALKHKAKIVYELEVSRFEEGKQKIKKVYATLKKADVYSE

IDADKNLQTTVWGKLAVASEISASYTSQFCGACKKLWRAEMQVDETITTQ

-continued
ELIGTVRVIKGGTLIDAIKDFMRPPIFDENDTPFPKYRDFCDKHHISKKM

RGNSCLFICPFCRANADADIQASQTIALLRYVKEEKKVEDYFERFRKLKN

IKVLGQMKKI

The term "effective amount," as used herein, refers to an amount of a biologically active agent that is sufficient to elicit a desired biological response. For example, in some embodiments, an effective amount of a nucleobase editor may refer to the amount of the nucleobase editor that is sufficient to induce mutation of a target site specifically bound mutated by the nucleobase editor. In some embodiments, an effective amount of a fusion protein provided herein, e.g., of a fusion protein comprising a nucleic acid programmable DNA binding protein and a deaminase domain (e.g., an adenosine deaminase domain) may refer to the amount of the fusion protein that is sufficient to induce editing of a target site specifically bound and edited by the fusion protein. As will be appreciated by the skilled artisan, the effective amount of an agent, e.g., a fusion protein, a nucleobase editor, a deaminase, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and on the agent being used.

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The term "proliferative disease," as used herein, refers to any disease in which cell or tissue homeostasis is disturbed in that a cell or cell population exhibits an abnormally elevated proliferation rate. Proliferative diseases include hyperproliferative diseases, such as pre-neoplastic hyperplastic conditions and neoplastic diseases. Neoplastic diseases are characterized by an abnormal proliferation of cells and include both benign and malignant neoplasias. Malignant neoplasia is also referred to as cancer.

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* (4th ed., Cold Spring Harbor Laboratory Press, Cold Spring Harbor, N.Y. (2012)), the entire contents of which are incorporated herein by reference.

The term "RNA-programmable nuclease," and "RNA-guided nuclease" are used interchangeably herein and refer to a nuclease that forms a complex with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., *Science* 337:816-821 (2012), the entire contents of which is incorporated herein by reference. Other examples of gRNAs (e.g., those including domain 2) can be found in U.S. Provisional patent application, U.S. Ser. No. 61/874,682, filed Sep. 6, 2013, entitled "Switchable Cas9 Nucleases And Uses Thereof," and U.S. Provisional patent application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example, Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663 (2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607 (2011); and "A programmable dual-RNA-guided DNA endonuclease in adaptive bacterial immunity." Jinek M., Chylinski K., Fonfara I., Hauer M., Doudna J. A., Charpentier E. Science 337:816-821 (2012), the entire contents of each of which are incorporated herein by reference.

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al., Multiplex genome engineering using CRISPR/Cas systems. *Science* 339, 819-823 (2013); Mali, P. et al., RNA-guided human genome engineering via Cas9. *Science* 339, 823-826 (2013); Hwang, W. Y. et al., Efficient genome editing in zebrafish using a CRISPR-Cas system. *Nature biotechnology* 31, 227-229 (2013); Jinek, M. et al., RNA-programmed genome editing in human cells. *eLife* 2, e00471 (2013); Dicarlo, J. E. et al., Genome engineering in *Saccharomyces cerevisiae* using CRISPR-Cas systems. *Nucleic acids research* (2013); Jiang, W. et al. RNA-guided editing of bacterial genomes using CRISPR-Cas systems. *Nature biotechnology* 31, 233-239 (2013); the entire contents of each of which are incorporated herein by reference).

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

The term "target site" refers to a sequence within a nucleic acid molecule that is deaminated by a deaminase or a fusion protein comprising a deaminase, (e.g., a dCas9-adenosine deaminase fusion protein provided herein).

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

DETAILED DESCRIPTION OF THE INVENTION

Some aspects of this disclosure relate to proteins that deaminate the nucleobase adenine. This disclosure provides adenosine deaminase proteins that are capable of deaminating (i.e., removing an amine group) adenine of a deoxyadenosine residue in deoxyribonucleic acid (DNA). For example, the adenosine deaminases provided herein are capable of deaminating adenine of a deoxyadenosine residue of DNA. It should be appreciated that there were no known adenosine deaminases capable of deaminating deoxyadenosine in DNA before the present invention. Other aspects of the disclosure provide fusion proteins that comprise an adenosine deaminase (e.g., an adenosine deaminase that deaminates deoxyadenosine in DNA as described herein) and a domain (e.g., a Cas9 or a Cpf1 protein) capable of binding to a specific nucleotide sequence. The deamination of an adenosine by an adenosine deaminase can lead to a point mutation, this process is referred to herein as nucleic-acid editing. For example, the adenosine may be converted to an inosine residue, which typically base pairs with a cytosine residue. Such fusion proteins are useful inter alia for targeted editing of nucleic acid sequences. Such fusion proteins may be used for targeted editing of DNA in vitro, e.g., for the generation of mutant cells or animals; for the introduction of targeted mutations, e.g., for the correction of genetic defects in cells ex vivo, e.g., in cells obtained from a subject that are subsequently re-introduced into the same or another subject; and for the introduction of targeted mutations in vivo, e.g., the correction of genetic defects or the introduction of deactivating mutations in disease-associated genes in a subject. As an example, diseases that can be treated by making an A to G, or a T to C mutation may be treated using the nucleobase editors provided herein. The invention provides deaminases, fusion proteins, nucleic acids, vectors, cells, compositions, methods, kits, systems, etc. that utilize the deaminases and nucleobase editors.

In some embodiments, the nucleobase editors provided herein can be made by fusing together one or more protein domains, thereby generating a fusion protein. In certain embodiments, the fusion proteins provided herein comprise one or more features that improve the base editing activity (e.g., efficiency, selectivity, and specificity) of the fusion proteins. For example, the fusion proteins provided herein may comprise a Cas9 domain that has reduced nuclease activity. In some embodiments, the fusion proteins provided herein may have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand. In some embodiments, any of the fusion proteins provided herein further comprise an inhibitor of inosine base excision repair, for example, a uracil glycosylase inhibitor (UGI) domain or a catalytically inactive inosine-specific nuclease (dISN). Without wishing to be bound by any particular theory, the UGI domain or dISN may inhibit or prevent base excision repair of a deaminated adenosine residue (e.g., inosine), which may improve the activity or efficiency of the base editor.

Adenosine Deaminases

Some aspects of the disclosure provide adenosine deaminases. In some embodiments, the adenosine deaminases provided herein are capable of deaminating adenine. In some embodiments, the adenosine deaminases provided herein are capable of deaminating adenine in a deoxyadenosine residue of DNA. The adenosine deaminase may be derived from any suitable organism (e.g., E. coli). In some embodiments, the adenine deaminase is a naturally-occurring adenosine deaminase that includes one or more mutations corresponding to any of the mutations provided herein (e.g., mutations in ecTadA). One of skill in the art will be able to identify the corresponding residue in any homologous protein and in the respective encoding nucleic acid by methods well known in the art, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

Figure 92:
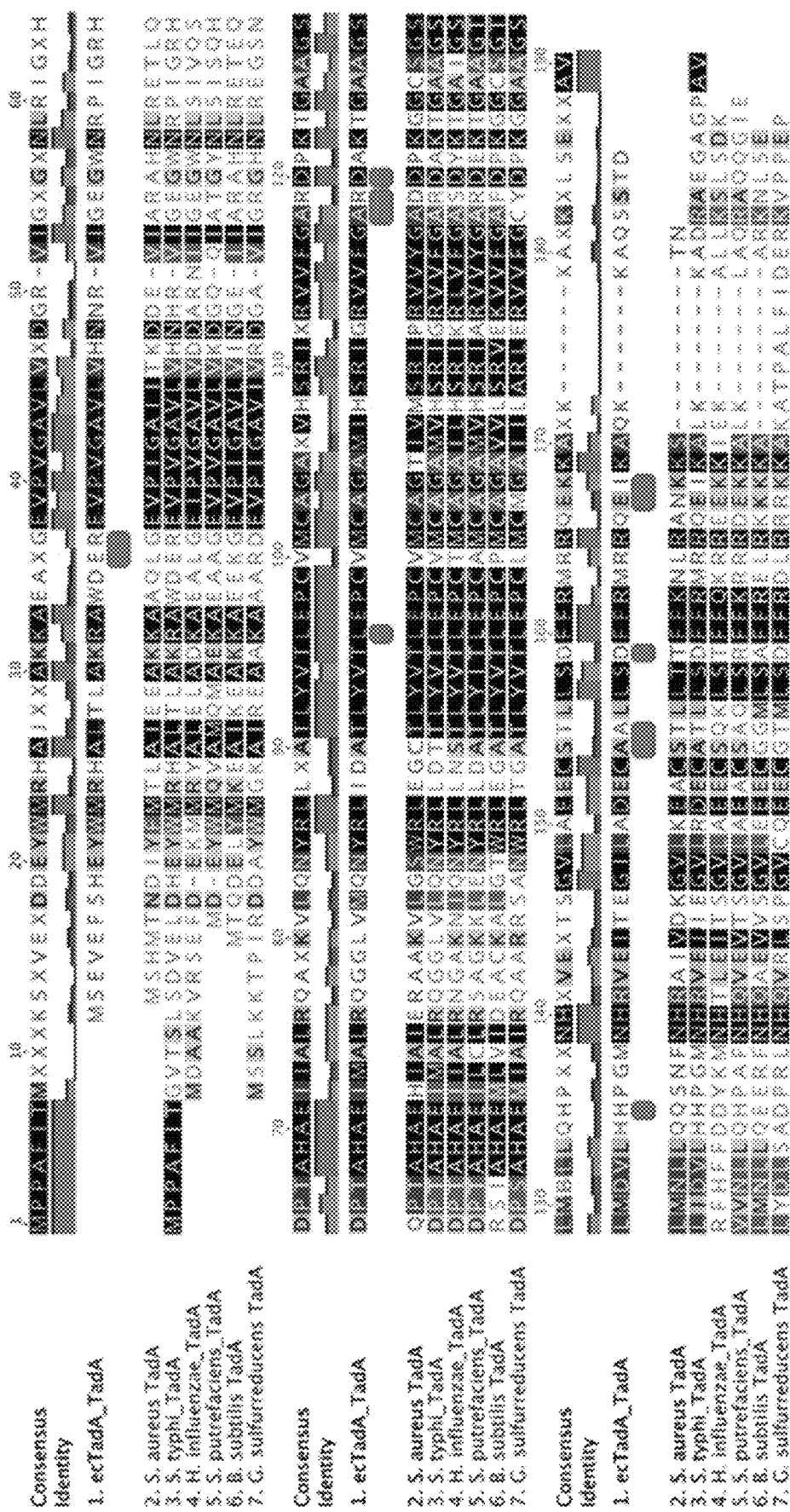
FIG. 92 shows a sequence alignment of prokaryotic TadA amino acid sequences. The sequences correspond to SEQ ID NOs: 634-657 from top to bottom respectively.
Figure 93:
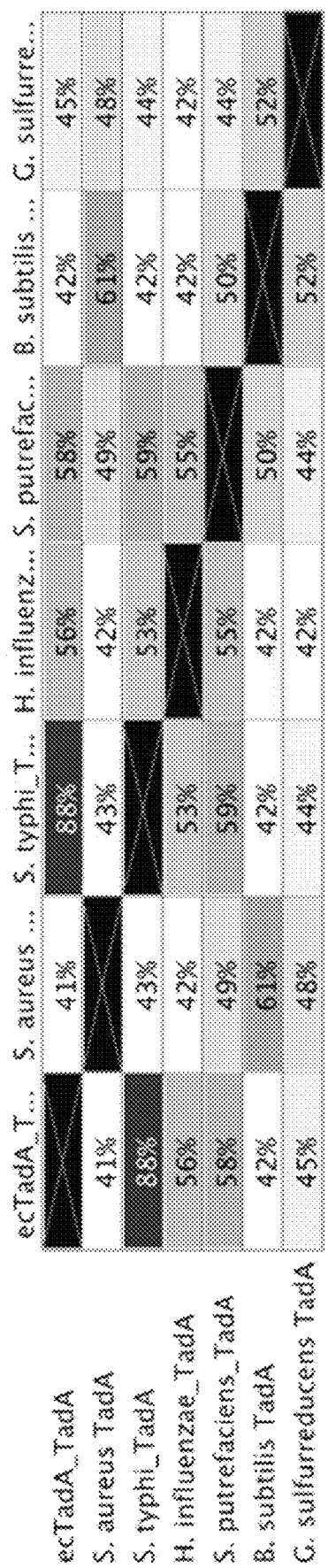
FIG. 93 shows a schematic of the relative sequence identity analysis of TadA amino acid sequences.

Exemplary alignment of prokaryotic TadA proteins is shown in FIG. 92. The residues highlighted in blue are the residues which may be important for catalyzing A to I deamination on ssDNA. Accordingly, it should be appreciated that any of the mutations identified in ecTadA provided herein may be made in any homologous residue in another adenine deaminase, for example, a TadA deaminase from another bacterium. FIG. 93 shows the relative sequence identity analysis (heatmap of sequence identity):

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1, 64-84, 420-437, 672-684, or to any of the adenosine deaminases provided herein. It should be appreciated that adenosine deaminases provided herein may include one or more mutations (e.g., any of the mutations provided herein). The disclosure provides any deaminase domains with a certain percent identify plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 1, 64-84, 420-437, 672-684, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences set forth in SEQ ID NOs: 1, 64-84, 420-437, 672-684, or any of the adenosine deaminases provided herein.

Evolution #1 and #2 Mutations

In some embodiments, the adenosine deaminase comprises a D108X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation in SEQ ID NO: 1, or a corresponding mutation in another adenosine deaminase. An exemplary alignment of deaminases is shown in FIG. 92. It should be appreciated, however, that additional deaminases may similarly be aligned to identify homologous amino acid residues that can be mutated as provided herein.

In some embodiments, the adenosine deaminse comprises an A106X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A106V mutation in SEQ ID NO: 1, or a corresponding mutation in another adenosine deaminase.

In some embodiments, the adenosine deaminase comprises a E155X mutation in SEQ ID NO: 1, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation in SEQ ID NO: 1, or a corresponding mutation in another adenosine deaminase.

In some embodiments, the adenosine deaminase comprises a D147X mutation in SEQ ID NO: 1, or a corresponding mutation in another adenosine deaminase, where the presence of X indicates any amino acid other than the corresponding amino acid in the wild-type adenosine deaminase. In some embodiments, the adenosine deaminase comprises a D147Y, mutation in SEQ ID NO: 1, or a corresponding mutation in another adenosine deaminase.

It should be appreciated that any of the mutations provided herein (e.g., based on the ecTadA amino acid sequence of SEQ ID NO: 1) may be introduced into other adenosine deaminases, such as *S. aureus* TadA (saTadA), or other adenosine deaminases (e.g., bacterial adenosine deaminases). It would be apparent to the skilled artisan how to identify amino acid residues from other adenosine deaminases that are homologous to the mutated residues in ecTadA. Thus, any of the mutations identified in ecTadA may be made in other adenosine deaminases that have homologous amino acid residues. It should also be appreciated that any of the mutations provided herein may be made individually or in any combination in ecTadA or another adenosine deaminase. For example, an adenosine deaminase may contain a D108N, a A106V, a E155V, and/or a D147Y mutation in ecTadA SEQ ID NO: 1, or a corresponding mutation in another adenosine deaminase. In some embodiments, an adenosine deaminase comprises the following group of mutations (groups of mutations are separated by a ";") in ecTadA SEQ ID NO: 1, or corresponding mutations in another adenosine deaminase:
D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D147Y; and D108N, A106V, E55V, and D147Y. It should be appreciated, however, that any combination of corresponding mutations provided herein may be made in an adenosine deaminase (e.g., ecTadA). In some embodiments, an adenosine deaminase comprises one or more of the mutations shown in Table 4, which identifies individual mutations and combinations of mutations made in ecTadA and saTadA. In some embodiments, an adenosine deaminase comprises a mutation or combination of mutations shown in Table 4.

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, I156X, and/or K157X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, I95I, V102A, F104L, A106V, R107C, or R107H, or R107P, D108G, or D108N, or D108V, or D108A, or D108Y, K110I, M118K, N127S, A138V, F149Y, M151V, R153C, Q154L, I156D, and/or K157R mutation in SEQ ID NO: 1, or one or more corresponding mutations in another adenosine deaminase. In some embodiments, the adenosine deaminase comprises one or more of the mutations provided in FIG. 11 corresponding to SEQ ID NO: 1, or one or more corresponding mutations in another adenosine deaminase. In some embodiments, the adenosine deaminase comprises the mutation or mutations of any one of constructs 1-16 shown in FIG. 11 or in any one of the constructs shown in Table 4 corresponding to SEQ ID NO: 1, or a corresponding mutation or mutations in another adenosine deaminase.

In some embodiments, the adenosine deaminase comprises one or more of a H8X, D108X, and/or N127X mutation in SEQ ID NO: 1, or one or more corresponding mutations in another adenosine deaminase, where X indicates the presence of any amino acid. In some embodiments, the adenosine deaminase comprises one or more of a H8Y, D108N, and/or N127S mutation in SEQ ID NO: 1, or one or more corresponding mutations in another adenosine deaminase.

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in SEQ ID NO: 1, or one or more corresponding mutations in another adenosine deaminase, where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in SEQ ID NO: 1, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of H8X, A106X, D108X, N127X, E155X, and K161X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X in SEQ ID NO: 1, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in SEQ ID NO: 1, or a corresponding mutation or mutations in another adenosine deaminase. In some embodiments, the adenosine deaminase comprises one, two, three, four, five, six, seven, or eight mutations selected from the group consisting of H8Y, M61I, M70V, D108N, N127S, Q154R, E155G and Q163H in SEQ ID NO: 1, or a corresponding mutation or mutations in another adenosine deaminase. In some embodiments, the adenosine deaminase comprises one, two, three, four, or five, mutations selected from the group consisting of H8Y, D108N, N127S, E155V, and T166P in SEQ ID NO: 1, or a corresponding mutation or mutations in another adenosine deaminase. In some embodiments, the adenosine deaminase comprises one, two, three, four, five, or six mutations selected from the group consisting of H8Y, A106T, D108N, N127S, E155D, and K161Q in SEQ ID NO: 1, or a corresponding mutation or mutations in another adenosine deaminase. In some embodiments, the adenosine deaminase comprises one, two, three, four, five, six, seven, or eight mutations selected from the group consisting of H8Y, R126W, L68Q, D108N, N127S, D147Y, and E155V in SEQ ID NO: 1, or a corresponding mutation or mutations in another adenosine deaminase. In some embodiments, the adenosine deaminase comprises one, two, three, four, or five, mutations selected from the group consisting of H8Y, D108N, A109T, N127S, and E155G in SEQ ID NO: 1, or a corresponding mutation or mutations in another adenosine deaminase.

In some embodiments, the adenosine deaminase comprises one or more of the mutations provided in FIG. 16 corresponding to SEQ ID NO: 1, or one or more corresponding mutations in another adenosine deaminase. In some embodiments, the adenosine deaminase comprises the mutations of any one of constructs pNMG-149 to pNMG-154 of FIG. 16, corresponding to SEQ ID NO: 1, or corresponding mutations in another adenosine deaminase. In some embodiments, the adenosine deaminase comprises a D108N, D108G, or D108V mutation in SEQ ID NO: 1, or corresponding mutations in another adenosine deaminase. In some embodiments, the adenosine deaminase comprises a A106V and D108N mutation in SEQ ID NO: 1, or corresponding mutations in another adenosine deaminase. In some embodiments, the adenosine deaminase comprises R107C and D108N mutations in SEQ ID NO: 1, or corresponding mutations in another adenosine deaminase. In some embodiments, the adenosine deaminase comprises a H8Y, D108N, N127S, D147Y, and Q154H mutation in SEQ ID NO: 1, or corresponding mutations in another adenosine deaminase. In some embodiments, the adenosine deaminase comprises a H8Y, R24W, D108N, N127S, D147Y, and E155V mutation in SEQ ID NO: 1, or corresponding mutations in another adenosine deaminase. In some embodiments, the adenosine deaminase comprises a D108N, D147Y, and E155V mutation in SEQ ID NO: 1, or corresponding mutations in another adenosine deaminase. In some embodiments, the adenosine deaminase comprises a H8Y, D108N, and S127S mutation in SEQ ID NO: 1, or corresponding mutations in another adenosine deaminase. In some embodiments, the adenosine deaminase comprises a A106V, D108N, D147Y and E155V mutation in SEQ ID NO: 1, or corresponding mutations in another adenosine deaminase.

Figures 96, 97:
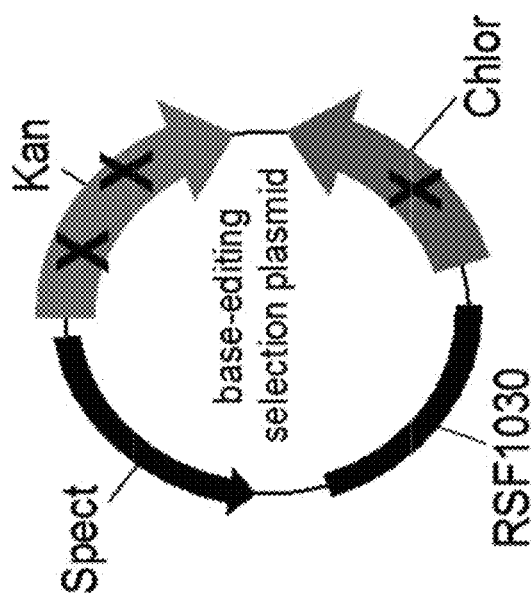
FIG. 96 shows a schematic of an exemplary base-editing selection plasmid.
FIG. 97 shows a list of clones including identified mutations in ecTadA.
Figure 98:
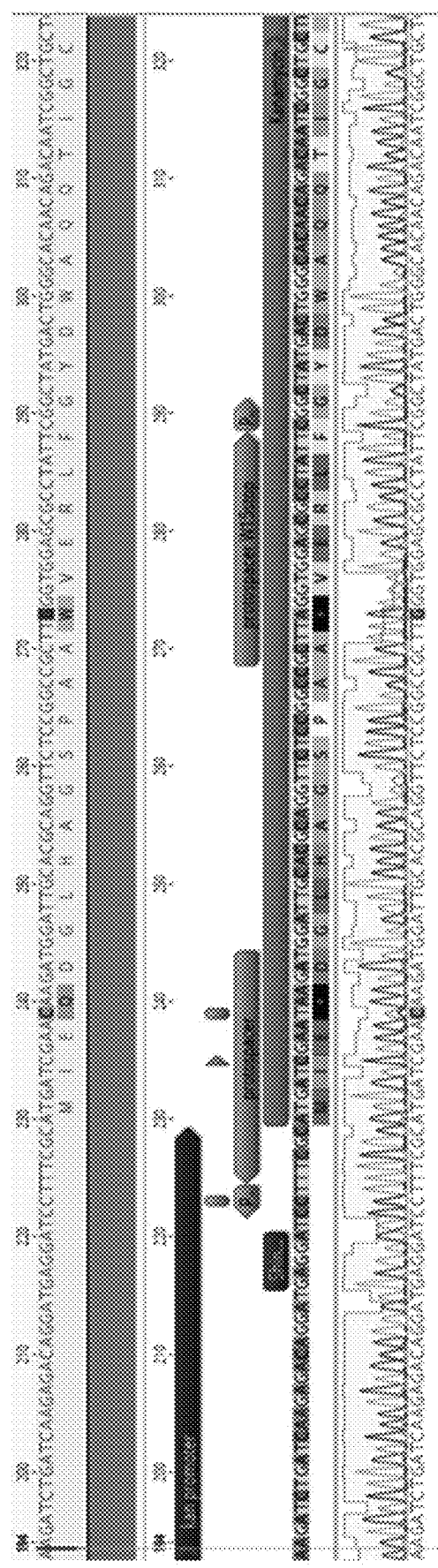
FIG. 98 shows an exemplary sequencing analysis of a selection plasmid from surviving colonies. The sequences correspond to SEQ ID NOs: 658-661, 5529-5530, and 662 from top to bottom and left to right, respectively.
Figures 99, 100:
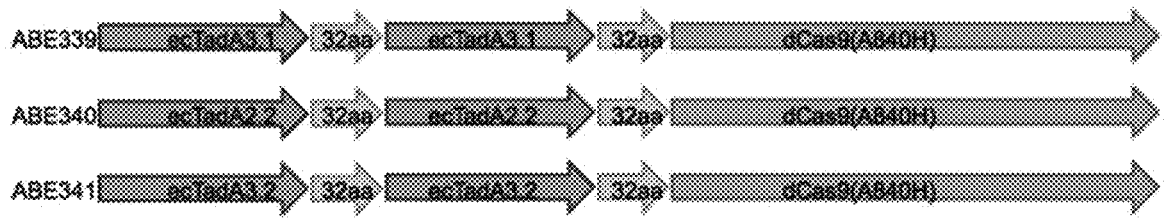
FIG. 99 shows a schematic of exemplary adenosine base editors from a third round of evolution.
FIG. 100 shows the percentage of A to G conversions in Hek293T cells.
Figure 101:
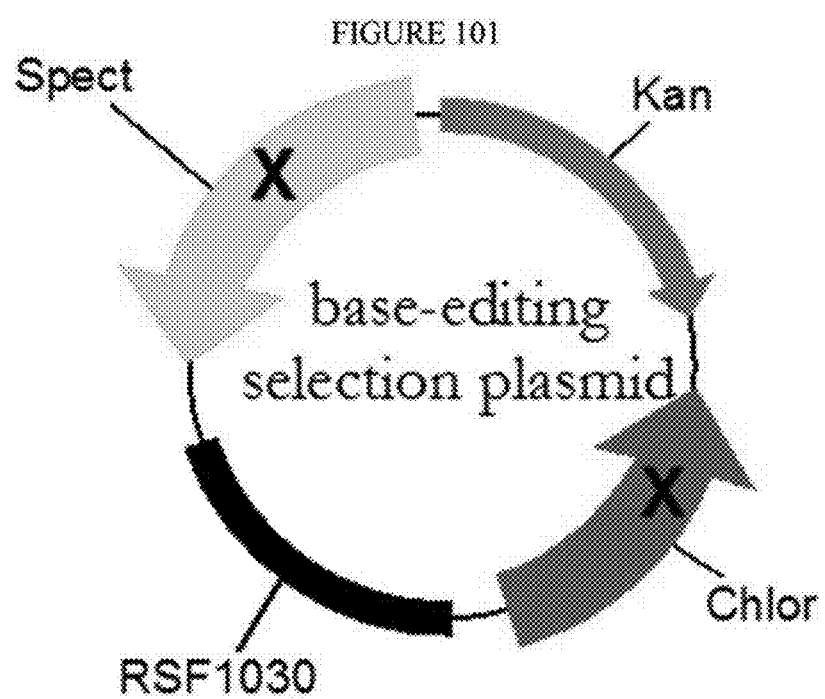
FIG. 101 shows a schematic of an exemplary base-editing selection plasmid.
Figure 102:
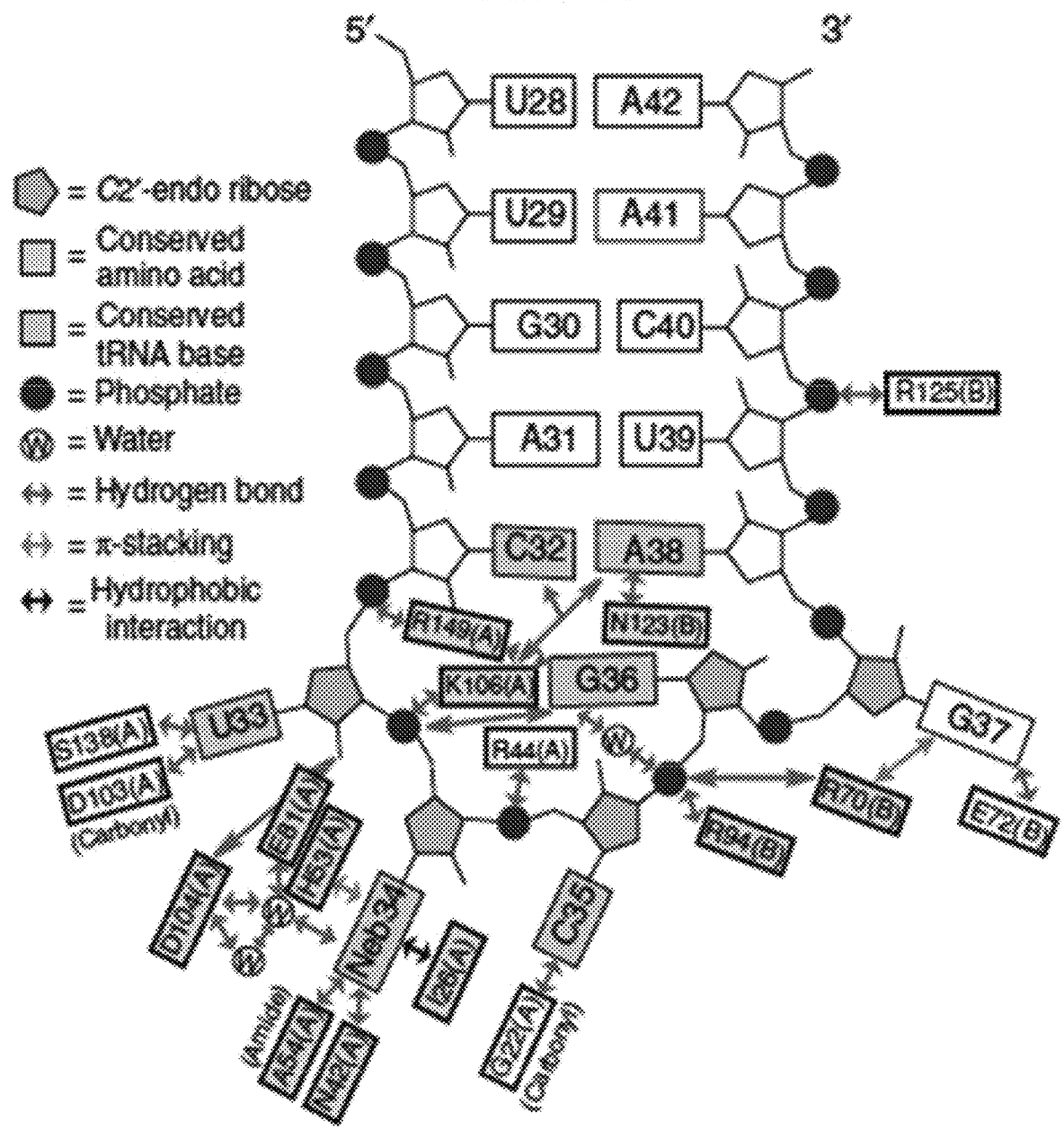
FIG. 102 shows a schematic representation of the verdine crystal structure of *S. aureus* TadA. The *S. aureus* TadA, a homolog of ecTadA, is shown with its tRNA substrate co-crystalized. Red arrows are the H-bond contacts with the various nucleic acids in the tRNA substrate. See Losey, H. C., et al., "Crystal structure of *Staphylococcus* sureus tRNA adenosine deaminase tadA in complex with RNA", *Nature Struct. Mol. Biol.* 2, 153-159 (2006).
Figure 103:
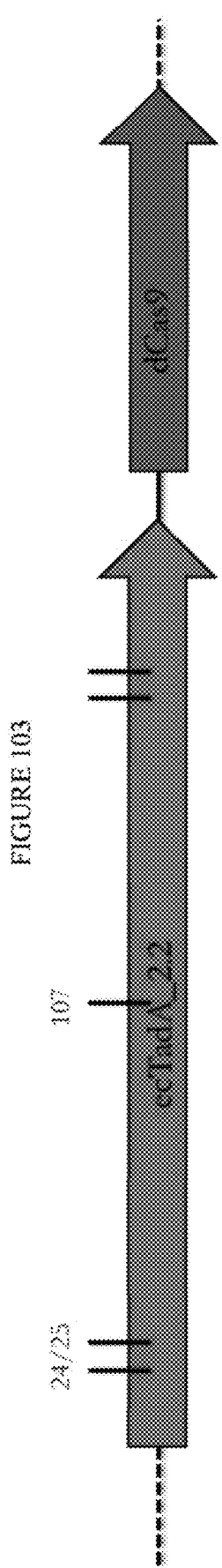
FIG. 103 shows a schematic of a construct containing ecTadA_2.2 and dCas9, identifying mutated ecTadA residues.
Figure 104:
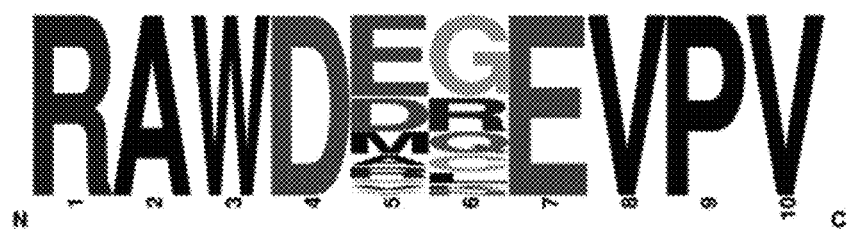
FIG. 104 shows results of ecTadA evolution (evolution #4) at sites E25 and R26.
Figure 105:
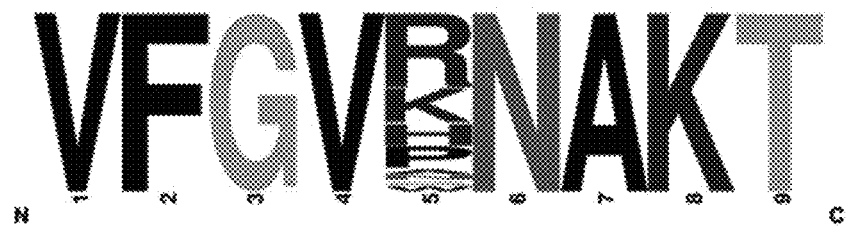
FIG. 105 shows results of ecTadA evolution (evolution #4) at site R107.
Figure 106:
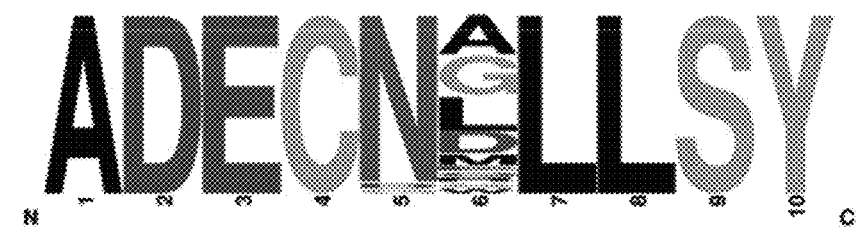
FIG. 106 shows results of ecTadA evolution (evolution #4) at sites A142 and A143.
Figure 107:
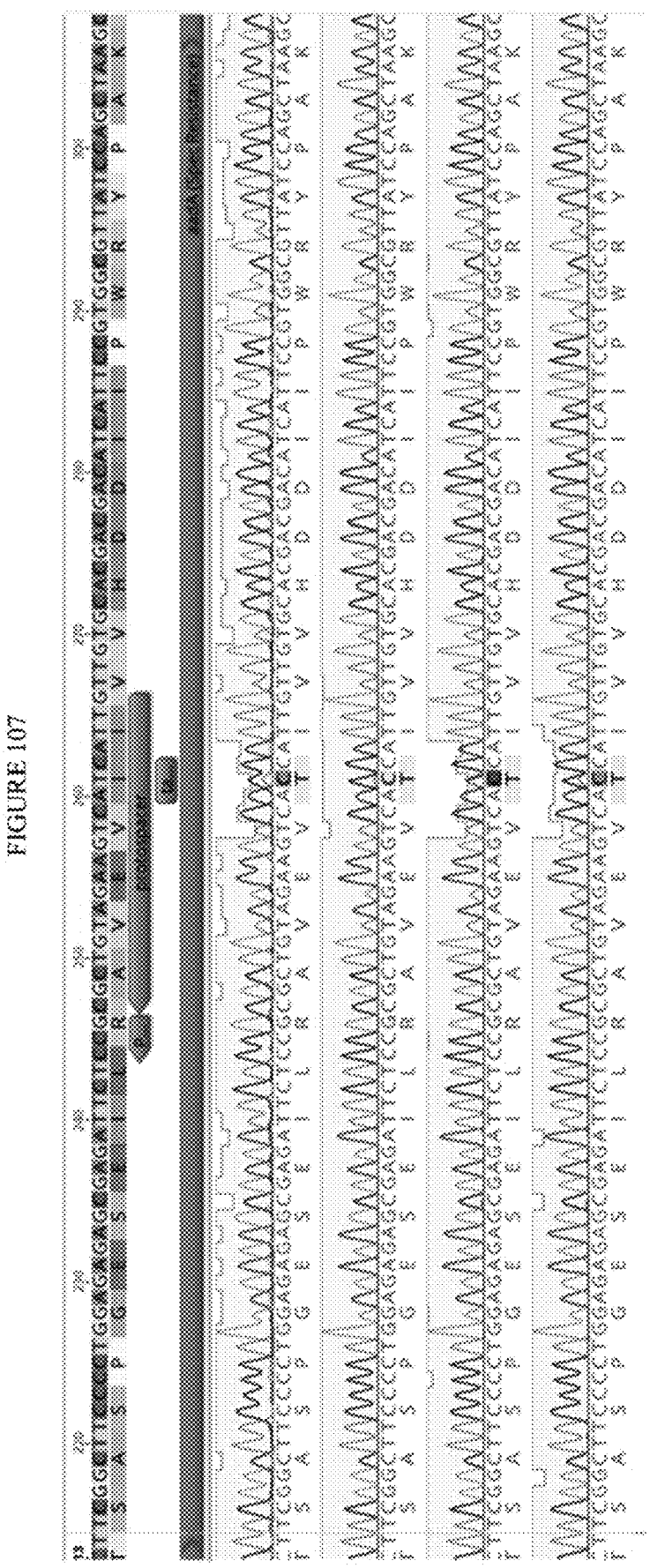
FIG. 107 shows an exemplary sequencing analysis of a selection plasmid from surviving colonies. The sequences correspond to SEQ ID NO: 662-671 from top to bottom respectively.
Figure 121:
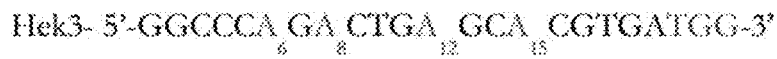

In some embodiments, the adenosine deaminase comprises one or more of a, S2X, H8X, I49X, L84X, H123X, N127X, I156X and/or K160X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, I156F and/or K160S mutation in SEQ ID NO: 1, or one or more corresponding mutations in another adenosine deaminase. In some embodiments, the adenosine deaminase comprises one or more of the mutations provided in FIG. 97 corresponding to SEQ ID NO: 1, or one or more corresponding mutations in another adenosine deaminase. In some embodiments, the adenosine deaminase comprises the mutation or mutations of any one of clones 1-3 shown in FIG. 97 corresponding to SEQ ID NO: 1, or a corresponding mutation or mutations in another adenosine deaminase.

In some embodiments, the adenosine deaminse comprises an L84X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an L84F mutation in SEQ ID NO: 1, or a corresponding mutation in another adenosine deaminase.

In some embodiments, the adenosine deaminse comprises an H123X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an H123Y mutation in SEQ ID NO: 1, or a corresponding mutation in another adenosine deaminase.

In some embodiments, the adenosine deaminse comprises an I157X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an I157F mutation in SEQ ID NO: 1, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and I156X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X in SEQ ID NO: 1, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in SEQ ID NO: 1, or a corresponding mutation or mutations in another adenosine deaminase. In some embodiments, the adenosine deaminase comprises one, two, three, four, five, or six mutations selected from the group consisting of S2A, I49F, A106V, D108N, D147Y, and E155V in SEQ ID NO: 1, or a corresponding mutation or mutations in another adenosine deaminase. In some embodiments, the adenosine deaminase comprises one, two, three, four, or five, mutations selected from the group consisting of H8Y, A106T, D108N, N127S, and K160S in SEQ ID NO: 1, or a corresponding mutation or mutations in another adenosine deaminase.

In some embodiments, the adenosine deaminase comprises one or more of a, E25X, R26X, R107X, A142X, and/or A143X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R07K, R107A, R107N, R107W, R107H, R107S, A142N, A142D, A142G, A143D, A143G, A143E, A143L, A143W, A143M, A143S, A143Q and/or A143R mutation in SEQ ID NO: 1, or one or more corresponding mutations in another adenosine deaminase. In some embodiments, the adenosine deaminase comprises one or more of the mutations provided in Table 7 corresponding to SEQ ID NO: 1, or one or more corresponding mutations in another adenosine deaminase. In some embodiments, the adenosine deaminase comprises the mutation or mutations of any one of clones 1-22 shown in Table 7 corresponding to SEQ ID NO: 1, or a corresponding mutation or mutations in another adenosine deaminase.

In some embodiments, the adenosine deaminse comprises an E25X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an E25M, E25D, E25A, E25R, E25V, E25S, or E25Y mutation in SEQ ID NO: 1, or a corresponding mutation in another adenosine deaminase.

In some embodiments, the adenosine deaminse comprises an R26X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an, R26G, R26N, R26Q, R26C, R26L, or R26K mutation in SEQ ID NO: 1, or a corresponding mutation in another adenosine deaminase.

In some embodiments, the adenosine deaminse comprises an R107X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an R107P, R07K, R107A, R107N, R107W, R107H, or R107S mutation in SEQ ID NO: 1, or a corresponding mutation in another adenosine deaminase.

In some embodiments, the adenosine deaminse comprises an A142X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation in SEQ ID NO: 1, or a corresponding mutation in another adenosine deaminase.

In some embodiments, the adenosine deaminse comprises an A143X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation in SEQ ID NO: 1, or a corresponding mutation in another adenosine deaminase.

In some embodiments, the adenosine deaminase comprises one or more of a, H36X, N37X, P48X, I49X, R51X, M70X, N72X, D77X, E134X, S146X, Q154X, K157X, and/or K161X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S146R, S146C, Q154H, K157N, and/or K161T mutation in SEQ ID NO: 1, or one or more corresponding mutations in another adenosine deaminase. In some embodiments, the adenosine deaminase comprises one or more of the mutations provided in any one of FIGS. 125-128 corresponding to SEQ ID NO: 1, or one or more corresponding mutations in another adenosine deaminase. In some embodiments, the adenosine deaminase comprises the mutation or mutations of any one of clones 1-11 shown in any one of FIGS. 125-128 corresponding to SEQ ID NO: 1, or a corresponding mutation or mutations in another adenosine deaminase.

In some embodiments, the adenosine deaminse comprises an H36X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an H36L mutation in SEQ ID NO: 1, or a corresponding mutation in another adenosine deaminase.

In some embodiments, the adenosine deaminse comprises an N37X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an N37T, or N37S mutation in SEQ ID NO: 1, or a corresponding mutation in another adenosine deaminase.

In some embodiments, the adenosine deaminse comprises an P48X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an P48T, or P48L mutation in SEQ ID NO: 1, or a corresponding mutation in another adenosine deaminase.

In some embodiments, the adenosine deaminse comprises an R51X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an R51H, or R51L mutation in SEQ ID NO: 1, or a corresponding mutation in another adenosine deaminase.

In some embodiments, the adenosine deaminse comprises an S146X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an S146R, or S146C mutation in SEQ ID NO: 1, or a corresponding mutation in another adenosine deaminase.

In some embodiments, the adenosine deaminse comprises an K157X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a K157N mutation in SEQ ID NO: 1, or a corresponding mutation in another adenosine deaminase.

In some embodiments, the adenosine deaminase comprises an P48X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a P48S, P48T, or P48A mutation in SEQ ID NO: 1, or a corresponding mutation in another adenosine deaminase.

In some embodiments, the adenosine deaminase comprises an A142X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a A142N mutation in SEQ ID NO: 1, or a corresponding mutation in another adenosine deaminase.

In some embodiments, the adenosine deaminse comprises an W23X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a W23R, or W23L mutation in SEQ ID NO: 1, or a corresponding mutation in another adenosine deaminase.

In some embodiments, the adenosine deaminse comprises an R152X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a R152P, or R52H mutation in SEQ ID NO: 1, or a corresponding mutation in another adenosine deaminase.

It should be appreciated that the adenosine deaminase (e.g., a first or second adenosine deaminase) may comprise one or more of the mutations provided in any of the adenosine deaminases (e.g., ecTadA adenosine deaminases) shown in Table 4. In some embodiments, the adenosine deaminase comprises the combination of mutations of any of the adenosine deaminases (e.g., ecTadA adenosine deaminases) shown in Table 4. For example, the adenosine deaminase may comprise the mutations H36L, R51L, L84F, A106V, D108N, H123Y, S146C, D147Y, E155V, I156F, and K157N, which are shown in the second ecTadA (relative to SEQ ID NO: 1) of clone pNMG-477. In some embodiments, the adenosine deaminase comprises the following combination of mutations relative to SEQ ID NO:1, where each mutation of a combination is separated by a "_" and each combination of mutations is between parentheses: (A106V_D108N), (R107C_D108N), (H8Y_D108N_S127S_D147Y_Q154H), (H8Y_R24W_D108N_N127S_D147Y_E155V), (D108N_D147Y_E155V), (H8Y_D108N_S127S), (H8Y_D108N_N127S_D147Y_Q154H), (A106V_D108N_D147Y_E155V), (D108Q_D147Y_E155V), (D108M_D147Y_E155V), (D108L_D147Y_E155V), (D108K_D147Y_E155V), (D108I_D147Y_E155V), (D108F_D147Y_E155V), (A106V_D108N_D147Y), (A106V_D108M_D147Y_E155V), (E59A_A106V_D108N_D147Y_E155V), (E59A cat dead_A106V_D108N_D147Y_E155V), (L84F_A106V_D108N_H123Y_D147Y_E155V_I156Y), (L84F_A106V_D108N_H123Y_D147Y_E155V_I156F), (D103A_D014N), (G22P_D103A_D104N), (G22P_D103A_D104N_S138A), (D103A_D104N_S138A), (R26G_L84F_A106V_R107D_D108N_H123Y_A142N_A143D_D147Y_E155V_I156F), (E25G_R26G_L84F_A106V_R107H_D108N_H123Y_A142N_A143D_D147Y_E155V_I156F), (E25D_R26G_L84F_A106V_R107K_D108N_H123Y_A142N_A143G_D147Y_E155V_I156F), (R26Q_L84F_A106V_D108N_H123Y_A142N_D147Y_E155V_I156F), (E25M_R26G_L84F_A106V_R107P_D108N_H123Y_A142N_A143D_D147Y_E155V_I156F), (R26C_L84F_A106V_R107H_D108N_H123Y_A142N_D147Y_E155V_I156F), (L84F_A106V_D108N_H123Y_A142N_A143L_D147Y_E155V_I156F), (R26G_L84F_A106V_D108N_H123Y_A142N_D147Y_E155V_I156F), (E25A_R26G_L84F_A106V_R107N_D108N_H123Y_A142N_A143E_D147Y_E155V_I156F), (R26G_L84F_A106V_R107H_D108N_H123Y_A142N_A143D_D147Y_E155V_I156F), (A106V_D108N_A142N_D147Y_E155V), (R26G_A106V_D108N_A142N_D147Y_E155V), (E25D_R26G_A106V_R107K_D108N_A142N_A143G_D147Y_E155V), (R26G_A106V_D108N_R107H_A142N_A143D_D147Y_E155V), (E25D_R26G_A106V_D108N_A142N_D147Y_E155V), (A106V_R107K_D108N_A142N_D147Y_E155V), (A106V_D108N_A142N_A143G_D147Y_E155V),
(A106V_D108N_A142N_A143L_D147Y_E155V),
(H36L_R51L_L84F_A106V_D108N_H123Y_S146C_
D147Y_E155V_I156F_K157N),
(N37T_P48T_M70L_L84F_A106V_D108N_H123Y_
D147Y_I49V_E155V_I156F),
(N37S_L84F_A106V_D108N_H123Y_D147Y_E155V_
I156F_K161T),
(H36L_L84F_A106V_D108N_H123Y_D147Y_Q154H_
E155V_I156F),
(N72S_L84F_A106V_D108N_H123Y_S146R_D147Y_
E155V_I156F),
(H36L_P48L_L84F_A106V_D108N_H123Y_E134G_
D147Y_E155V_I156F),
(H36L_L84F_A106V_D108N_H123Y_D147Y_E155V_
I156F_K157N),
(H36L_L84F_A106V_D108N_H123Y_S146C_D147Y_
E155V_I156F),
(L84F_A106V_D108N_H123Y_S146R_D147Y_E155V_
I156F_K161T),
(N37S_R51H_D77G_L84F_A106V_D108N_H123Y_
D147Y_E155V_I156F),
(R51L_L84F_A106V_D108N_H123Y_D147Y_E155V_
I156F_K157N),
(D24G_Q71R_L84F_H96L_A106V_D108N_H123Y_
D147Y_E155V_I156F_K160E),
(H36L_G67V_L84F_A106V_D108N_H123Y_S146T_
D147Y_E155V_I156F),
(Q71L_L84F_A106V_D108N_H123Y_L137M_A143E_
D147Y_E155V_I156F),
(E25G_L84F_A106V_D108N_H123Y_D147Y_E155V_
I156F_Q159L),
(L84F_A91T_F104I_A106V_D108N_H123Y_D147Y_
E155V_I156F),
(N72D_L84F_A106V_D108N_H123Y_G125A_D147Y_
E155V_I156F),
(P48S_L84F_S97C_A106V_D108N_H123Y_D147Y_
E155V_I156F),
(W23G_L84F_A106V_D108N_H123Y_D147Y_E155V_
I156F),
(D24G_P48L_Q71R_L84F_A106V_D108N_H123Y_
D147Y_E155V_I156F_Q159L),
(L84F_A106V_D108N_H123Y_A142N_D147Y_E155V_
I156F),
(H36L_R51L_L84F_A106V_D108N_H123Y_A142N_
S146C_D147Y_E155V_I156F_K157N),
(N37S_L84F_A106V_D108N_H123Y_A142N_D147Y_
E155V_I156F_K161T),
(L84F_A106V_D108N_D147Y_E155V_I156F),
(R51L_L84F_A106V_D108N_H123Y_S146C_D147Y_
E155V_I156F_K157N_K161T),
(L84F_A106V_D108N_H123Y_S146C_D147Y_E155V_
I156F_K161T),
(L84F_A106V_D108N_H123Y_S146C_D147Y_E155V_
I156F_K157N_K160E_K161T),
(L84F_A106V_D108N_H123Y_S146C_D147Y_E155V_
I156F_K157N_K160E), (R74Q
L84F_A106V_D108N_H123Y_D147Y_E155V_I156F),
(R74A_L84F_A106V_D108N_H123Y_D147Y_E155V_
I156F),
(L84F_A106V_D108N_H123Y_D147Y_E155V_I156F),
(R74Q_L84F_A106V_D108N_H123Y_D147Y_E155V_
I156F),
(L84F_R98Q_A106V_D108N_H123Y_D147Y_E155V_
I156F),
(L84F_A106V_D108N_H123Y_R129Q_D147Y_E155V_
I156F),
(P48S_L84F_A106V_D108N_H123Y_A142N_D147Y_
E155V_I156F), (P48S_A142N),
(P48T_I49V_L84F_A106V_D108N_H123Y_A142N_
D147Y_E155V_I156F_L157N),
(P48T_I49V_A142N),
(H36L_P48S_R51L_L84F_A106V_D108N_H123Y_
S146C_D147Y_E155V_I156F_K157N),
(H36L_P48S_R51L_L84F_A106V_D108N_H123Y_
S146C_A142N_D147Y_E155V_I156F_K157N),
(H36L_P48T_I49V_R51L_L84F_A106V_D108N_
H123Y_S146C_D147Y_E155V_I156F_K157N),
(H36L_P48T_I49V_R51L_L84F_A106V_D108N_
H123Y_A142N_S146C_D147Y_E155V_I156F_K157N),
(H36L_P48A_R51L_L84F_A106V_D108N_H123Y_
S146C_D147Y_E155V_I156F_K157N),
(H36L_P48A_R51L_L84F_A106V_D108N_H123Y_
A142N_S146C_D147Y_E155V_I156F_K157N),
(H36L_P48A_R51L_L84F_A106V_D108N_H123Y_
S146C_A142N_D147Y_E155V_I156F_K157N),
(W23L_H36L_P48A_R51L_L84F_A106V_D108N_
H123Y_S146C_D147Y_E155V_I156F_K157N),
(W23R_H36L_P48A_R51L_L84F_A106V_D108N_
H123Y_S146C_D147Y_E155V_I156F_K157N),
(W23L_H36L_P48A_R51L_L84F_A106V_D108N_
H123Y_S146C_D147Y_E155V_I156F_K161T),
(H36L_P48A_R51L_L84F_A106V_D108N_H123Y_
S146C_D147Y_R152H_E155V_I156F_K157N),
(H36L_P48A_R51L_L84F_A106V_D108N_H123Y_
S146C_D147Y_R152P_E155V_I156F_K157N),
(W23L_H36L_P48A_R51L_L84F_A106V_D108N_
H123Y_S146C_D147Y_R152P_E155V_I156F_K157N),
(W23L_H36L_P48A_R51L_L84F_A106V_D108N_
H123Y_A142A_S146C_D147Y_E155V_I156F_K157N),
(W23L_H36L_P48A_R51L_L84F_A106V_D108N_
H123Y_A142A_S146C_D147Y_R152P_E155V_I156F_
K157N),
(W23L_H36L_P48A_R51L_L84F_A106V_D108N_
H123Y_S146R_D147Y_E155V_I156F_K161T),
(W23R_H36L_P48A_R51L_L84F_A106V_D108N_
H123Y_S146C_D147Y_R152P_E155V_I156F_K157N),
(H36L_P48A_R51L_L84F_A106V_D108N_H123Y_
A142N_S146C_D147Y_R152P_E155V_I156F_K157N).

In some embodiments, the adenosine deaminase comprises an amino acid sequence that is at least 60%, 65%, 70%, 75%, 80%, 85%, 90%, 95, 98%, 99%, or 99.5% identical to any one of SEQ ID NOs: 1, 64-84, 420-437, 672-684, or any of the adenosine deaminases provided herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth in SEQ ID NOs: 1, 64-84, 420-437, 672-684, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 166, identical contiguous amino acid residues as compared to any one of the amino acid sequences set forth in SEQ ID NOs: 1, 64-84, 420-437, 672-684, or any of the adenosine deaminases provided herein. In some embodiments, the adenosine deaminase comprises the amino acid sequence of any one of SEQ ID NOs: 1, 64-84, 420-437, 672-684, or any of the adenosine deaminases provided herein. In some embodiments, the adenosine deaminase consists of the amino acid sequence of any one of SEQ ID NOs: 1, 64-84, 420-437, 672-684, or any of the adenosine deaminases provided herein. The ecTadA sequences provided below are from ecTadA (SEQ ID NO: 1), absent the N-terminal methionine (M). The saTadA sequences provided below are from saTadA (SEQ DI NO: 8), absent the N-terminal methionine (M). For clarity, the amino acid numbering scheme used to identify the various amino acid mutations is derived from ecTadA (SEQ ID NO: 1) for *E. coli* TadA and saTadA (SEQ ID NO: 8) for *S. aureus* TadA. Amino acid mutations, relative to SEQ ID NO: 1 (ecTadA) or SEQ DI NO: 8 (saTadA), are indicated by underlining.

```
ecTadA
                                                              (SEQ ID NO: 64)
SEVEFSHEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGARDAKTG
AAGSLMDVLHHPGMNHRVEITEGILADECAALLSDFFRMRRQEIKAQKKAQSSTD ecTadA (D108N)
                                                              (SEQ ID NO: 65)
SEVEFSHEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGARNAKTG
AAGSLMDVLHHPGMNHRVEITEGILADECAALLSDFFRMRRQEIKAQKKAQSSTD ecTadA (D108G)
                                                              (SEQ ID NO: 66)
SEVEFSHEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGARGAKTG
AAGSLMDVLHHPGMNHRVEITEGILADECAALLSDFFRMRRQEIKAQKKAQSSTD ecTadA (D108V)
                                                              (SEQ ID NO: 67)
SEVEFSHEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGARVAKTG
AAGSLMDVLHHPGMNHRVEITEGILADECAALLSDFFRMRRQEIKAQKKAQSSTD ecTadA (H8Y, D108N, and N127S)
                                                              (SEQ ID NO: 68)
SEVEFSYEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGARNAKTG
AAGSLMDVLHHPGMSHRVEITEGILADECAALLSDFFRMRRQEIKAQKKAQSSTD ecTadA (H8Y, D108N, N127S, and E155D)
                                                              (SEQ ID NO: 69)
SEVEFSYEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGARNAKTG
AAGSLMDVLHHPGMSHRVEITEGILADECAALLSDFFRMRRQDIKAQKKAQSSTD ecTadA (H8Y, D108N, N127S, and E155G)
                                                              (SEQ ID NO: 70)
SEVEFSYEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGARNAKTG
AAGSLMDVLHHPGMSHRVEITEGILADECAALLSDFFRMRRQGIKAQKKAQSSTD ecTadA (H8Y, D108N, N127S, and E155V)
                                                              (SEQ ID NO: 71)
SEVEFSYEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGARNAKTG
AAGSLMDVLHHPGMSHRVEITEGILADECAALLSDFFRMRRQVIKAQKKAQSSTD ecTadA (A106V, D108N, D147Y, and E155V)
                                                              (SEQ ID NO: 72)
SEVEFSHEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGVRNAKTG
AAGSLMDVLHHPGMNHRVEITEGILADECAALLSYFFRMRRQVIKAQKKAQSSTD ecTadA (L84F, A106V, D108N, H123Y, D147Y, E155V, I156F)-
result of evolution #3
                                                              (SEQ ID NO: 73)
SEVEFSHEYWMRHALTLAKRAWDEREVPVGAVLVHNNRVIGEGWNRPIGRHDPTA
HAEIMALRQGGLVMQNYRLIDATLYVTFEPCVMCAGAMIHSRIGRVVFGVRNAKTG
AAGSLMDVLHYPGMNHRVEITEGILADECAALLSYFFRMRRQVFKAQKKAQSSTD ecTadA (S2A, I49F, A106V, D108N, D147Y, E155V)-
result of evolution #3
                                                              (SEQ ID NO: 74)
AEVEFSHEYWMRHALTLAKRAWDEREVPVGAVLVHNNRVIGEGWNRPFGRHDPTA
HAEIMALRQGGLVMQNYRLIDATLYVTLEPCVMCAGAMIHSRIGRVVFGVRNAKTG
AAGSLMDVLHHPGMNHRVEITEGILADECAALLSYFFRMRRQVIKAQKKAQSSTD ecTadA (H8Y, A106T, D108N, N127S, K160S)-
result of evolution #3
```

-continued (SEQ ID NO: 75)
SEVEFS<u>Y</u>EYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFG<u>TRN</u>AKTG
AAGSLMDVLHHPGM<u>S</u>HRVEITEGILADECAALLSDFFRMRRQEIKAQ<u>S</u>KAQSSTD ecTadA (R26G, L84F, A106V, R107H, D108N, H123Y, A142N, A143D, D147Y,
E155V, I156F)-result of evolution #4

(SEQ ID NO: 76)
SEVEFSHEYWMRHALTLAKRAWD<u>E</u>GEVPVGAVLVHNNRVIGEGWNRPIGRHDPTA
HAEIMALRQGGLVMQNYRLIDATLYVT<u>F</u>EPCVMCAGAMIHSRIGRVVFG<u>VHN</u>AKTG
AAGSLMDVL<u>HY</u>PGMNHRVEITEGILADEC<u>N</u>DLLS<u>Y</u>FFRMRRQ<u>V</u>FKAQKKAQSSTD ecTadA (E25G, R26G, L84F, A106V, R107H, D108N, H123Y, A142N, A143D,
D147Y, E155V, I156F)-result of evolution #4

(SEQ ID NO: 77)
SEVEFSHEYWMRHALTLAKRAWD<u>GG</u>EVPVGAVLVHNNRVIGEGWNRPIGRHDPTA
HAEIMALRQGGLVMQNYRLIDATLYVT<u>F</u>EPCVMCAGAMIHSRIGRVVFG<u>VHN</u>AKTG
AAGSLMDVLHYPGMNHRVEITEGILADEC<u>N</u>DLLS<u>Y</u>FFRMRRQ<u>V</u>FKAQKKAQSSTD ecTadA (E25D, R26G, L84F, A106V, R107K, D108N, H123Y, A142N, A143G,
D147Y, E155V, I156F)-result of evolution #4

(SEQ ID NO: 78)
SEVEFSHEYWMRHALTLAKRAWD<u>DG</u>EVPVGAVLVHNNRVIGEGWNRPIGRHDPTA
HAEIMALRQGGLVMQNYRLIDATLYVT<u>F</u>EPCVMCAGAMIHSRIGRVVFG<u>VKN</u>AKTG
AAGSLMDVL<u>HY</u>PGMNHRVEITEGILADEC<u>N</u>GLLS<u>Y</u>FFRMRRQ<u>V</u>FKAQKKAQSSTD ecTadA (R26Q, L84F, A106V, D108N, H123Y, A142N, D147Y, E155V, I156F)-
result of evolution #4

(SEQ ID NO: 79)
SEVEFSHEYWMRHALTLAKRAWDE<u>Q</u>EVPVGAVLVHNNRVIGEGWNRPIGRHDPTA
HAEIMALRQGGLVMQNYRLIDATLYVT<u>F</u>EPCVMCAGAMIHSRIGRVVFG<u>VRN</u>AKTG
AAGSLMDVL<u>HY</u>PGMNHRVEITEGILADECNALLS<u>Y</u>FFRMRRQ<u>V</u>FKAQKKAQSSTD ecTadA (E25M, R26G, L84F, A106V, R107P, D108N, H123Y, A142N, A143D,
D147Y, E155V, I156F)-result of evolution #4

(SEQ ID NO: 80)
SEVEFSHEYWMRHALTLAKRAWD<u>MG</u>EVPVGAVLVHNNRVIGEGWNRPIGRHDPTA
HAEIMALRQGGLVMQNYRLIDATLYVT<u>F</u>EPCVMCAGAMIHSRIGRVVFG<u>VPN</u>AKTG
AAGSLMDVL<u>HY</u>PGMNHRVEITEGILADEC<u>N</u>DLLS<u>Y</u>FFRMRRQ<u>V</u>FKAQKKAQSSTD ecTadA (R26C, L84F, A106V, R107H, D108N, H123Y, A142N, D147Y, E155V,
I156F)-result of evolution #4

(SEQ ID NO: 81)
SEVEFSHEYWMRHALTLAKRAWDE<u>C</u>EVPVGAVLVHNNRVIGEGWNRPIGRHDPTA
HAEIMALRQGGLVMQNYRLIDATLYVT<u>F</u>EPCVMCAGAMIHSRIGRVVFG<u>VHN</u>AKTG
AAGSLMDVL<u>HY</u>PGMNHRVEITEGILADEC<u>N</u>ALLS<u>Y</u>FFRMRRQ<u>V</u>FKAQKKAQSSTD ecTadA (L84F, A106V, D108N, H123Y, A142N, A143L, D147Y, E155V,
I156F)-result of evolution #4

(SEQ ID NO: 82)
SEVEFSHEYWMRHALTLAKRAWDEREVPVGAVLVHNNRVIGEGWNRPIGRHDPTA
HAEIMALRQGGLVMQNYRLIDATLYVT<u>F</u>EPCVMCAGAMIHSRIGRVVFG<u>VRN</u>AKTG
AAGSLMDVL<u>HY</u>PGMNHRVEITEGILADEC<u>N</u>LLLS<u>Y</u>FFRMRRQ<u>V</u>FKAQKKAQSSTD ecTadA (R26G, L84F, A106V, D108N, H123Y, A142N, D147Y, E155V,
I156F)-result of evolution #4

(SEQ ID NO: 83)
SEVEFSHEYWMRHALTLAKRAWD<u>E</u>GEVPVGAVLVHNNRVIGEGWNRPIGRHDPTA
HAEIMALRQGGLVMQNYRLIDATLYVT<u>F</u>EPCVMCAGAMIHSRIGRVVFG<u>VRN</u>AKTG
AAGSLMDVL<u>HY</u>PGMNHRVEITEGILADEC<u>N</u>ALLS<u>Y</u>FFRMRRQ<u>V</u>FKAQKKAQSSTD ecTadA (E25A, R26G, L84F, A106V, R107N, D108N, H123Y, A142N, A143E,
D147Y, E155V, I156F)-result of evolution #4

(SEQ ID NO: 420)
SEVEFSHEYWMRHALTLAKRAWD<u>AG</u>EVPVGAVLVHNNRVIGEGWNRPIGRHDPTA
HAEIMALRQGGLVMQNYRLIDATLYVT<u>F</u>EPCVMCAGAMIHSRIGRVVFG<u>VNN</u>AKTG
AAGSLMDVL<u>HY</u>PGMNHRVEITEGILADEC<u>N</u>ELLS<u>Y</u>FFRMRRQ<u>V</u>FKAQKKAQSSTD ecTadA (L84F, A106V, D108N, H123Y, D147Y, E155V, I156F)-
mutations from evolution #'s 1-3

(SEQ ID NO: 421)
SEVEFSHEYWMRHALTLAKRAWDEREVPVGAVLVHNNRVIGEGWNRPIGRHDPTA
HAEIMALRQGGLVMQNYRLIDATLYVT<u>F</u>EPCVMCAGAMIHSRIGRVVFG<u>VRN</u>AKTG
AAGSLMDVL<u>HY</u>PGMNHRVEITEGILADECAALLS<u>Y</u>FFRMRRQ<u>V</u>FKAQKKAQSSTD ecTadA (N37T, P48T, L84F, A106V, D108N, H123Y, D147Y, E155V,
I156F)-mutations from evolution # 5-1

(SEQ ID NO: 422)
SEVEFSHEYWMRHALTLAKRAWDEREVPVGAVLVHTNRVIGEGWNRTIGRHDPTA
HAEIMALRQGGLVMQNYRLIDATLYVTFEPCVMCAGAMIHSRIGRVVFGVRNAKTG
AAGSLMDVLHYPGMNHRVEITEGILADECAALLSYFFRMRRQVFKAQKKAQSSTD ecTadA (N37S, L84F, A106V, D108N, H123Y, D147Y, E155V, I156F)-
mutations from evolution # 5-2
(SEQ ID NO: 423)
SEVEFSHEYWMRHALTLAKRAWDEREVPVGAVLVHSNRVIGEGWNRPIGRHDPTA
HAEIMALRQGGLVMQNYRLIDATLYVTFEPCVMCAGAMIHSRIGRVVFGVRNAKTG
AAGSLMDVLHYPGMNHRVEITEGILADECAALLSYFFRMRRQVFKAQKKAQSSTD ecTadA (H36L, L84F, A106V, D108N, H123Y, D147Y, E155V, I156F)-
mutations from evolution # 5-3
(SEQ ID NO: 424)
SEVEFSHEYWMRHALTLAKRAWDEREVPVGAVLVLNNRVIGEGWNRPIGRHDPTA
HAEIMALRQGGLVMQNYRLIDATLYVTFEPCVMCAGAMIHSRIGRVVFGVRNAKTG
AAGSLMDVLHYPGMNHRVEITEGILADECAALLSYFFRMRRQVFKAQKKAQSSTD ecTadA (L84F, A106V, D108N, H123Y, S146R, D147Y, E155V, I156F)-
mutations from evolution # 5-4
(SEQ ID NO: 425)
SEVEFSHEYWMRHALTLAKRAWDEREVPVGAVLVHNNRVIGEGWNRPIGRHDPTA
HAEIMALRQGGLVMQNYRLIDATLYVTFEPCVMCAGAMIHSRIGRVVFGVRNAKTG
AAGSLMDVLHYPGMNHRVEITEGILADECAALLRYFFRMRRQVFKAQKKAQSSTD ecTadA (H36L, P48L, L84F, A106V, D108N, H123Y, D147Y, E155V, I156F)-
mutations from evolution # 5-5
(SEQ ID NO: 426)
SEVEFSHEYWMRHALTLAKRAWDEREVPVGAVLVLNNRVIGEGWNRLIGRHDPTA
HAEIMALRQGGLVMQNYRLIDATLYVTFEPCVMCAGAMIHSRIGRVVFGVRNAKTG
AAGSLMDVLHYPGMNHRVEITEGILADECAALLSYFFRMRRQVFKAQKKAQSSTD ecTadA (H36L, L84F, A106V, D108N, H123Y, D147Y, E155V, K57N, I156F)-
mutations from evolution # 5-6
(SEQ ID NO: 427)
SEVEFSHEYWMRHALTLAKRAWDEREVPVGAVLVLNNRVIGEGWNRPIGRHDPTA
HAEIMALRQGGLVMQNYRLIDATLYVTFEPCVMCAGAMIHSRIGRVVFGVRNAKTG
AAGSLMDVLHYPGMNHRVEITEGILADECAALLSYFFRMRRQVFNAQKKAQSSTD ecTadA (H36L, L84F, A106V, D108N, H123Y, S146C, D147Y, E155V, I156F)-
mutations from evolution # 5-7
(SEQ ID NO: 428)
SEVEFSHEYWMRHALTLAKRAWDEREVPVGAVLVLNNRVIGEGWNRPIGRHDPTA
HAEIMALRQGGLVMQNYRLIDATLYVTFEPCVMCAGAMIHSRIGRVVFGVRNAKTG
AAGSLMDVLHYPGMNHRVEITEGILADECAALLCYFFRMRRQVFKAQKKAQSSTD ecTadA (L84F, A106V, D108N, H123Y, S146R, D147Y, E155V, I156F)-
mutations from evolution # 5-8
(SEQ ID NO: 429)
SEVEFSHEYWMRHALTLAKRAWDEREVPVGAVLVHNNRVIGEGWNRPIGRHDPTA
HAEIMALRQGGLVMQNYRLIDATLYVTFEPCVMCAGAMIHSRIGRVVFGVRNAKTG
AAGSLMDVLHYPGMNHRVEITEGILADECAALLRYFFRMRRQVFKAQKKAQSSTD ecTadA (N37S, R51H, L84F, A106V, D108N, H123Y, D147Y, E155V, I156F)-
mutations from evolution # 5-9
(SEQ ID NO: 430)
SEVEFSHEYWMRHALTLAKRAWDEREVPVGAVLVHSNRVIGEGWNRPIGHHDPTA
HAEIMALRQGGLVMQNYRLIDATLYVTFEPCVMCAGAMIHSRIGRVVFGVRNAKTG
AAGSLMDVLHYPGMNHRVEITEGILADECAALLSYFFRMRRQVFKAQKKAQSSTD ecTadA (R51L, L84F, A106V, D108N, H123Y, D147Y, E155V, I156F, K157N)-mutations from evolution # 5-10
(SEQ ID NO: 431)
SEVEFSHEYWMRHALTLAKRAWDEREVPVGAVLVHNNRVIGEGWNRPIGLHDPTA
HAEIMALRQGGLVMQNYRLIDATLYVTFEPCVMCAGAMIHSRIGRVVFGVRNAKTG
AAGSLMDVLHYPGMNHRVEITEGILADECAALLSYFFRMRRQVFNAQKKAQSSTD ecTadA (R51H, L84F, A106V, D108N, H123Y, D147Y, E155V, I156F, K157N)-
mutations from evolution # 5-11
(SEQ ID NO: 432)
SEVEFSHEYWMRHALTLAKRAWDEREVPVGAVLVHNNRVIGEGWNRPIGHHDPTA
HAEIMALRQGGLVMQNYRLIDATLYVTFEPCVMCAGAMIHSRIGRVVFGVRNAKTG
AAGSLMDVLHYPGMNHRVEITEGILADECAALLSYFFRMRRQVFNAQKKAQSSTD saTadA (wt)-as used in pNMG-345:

```
                                                                (SEQ ID NO: 8)
MGSHMTNDIYFMTLAIEEAKKAAQLGEVPIGAIITKDDEVIARAHNLRETLQQPTAH
AEHIAIERAAKVLGSWRLEGCTLYVTLEPCVMCAGTIVMSRIPRVVYGADDPKGGCS
GSLMNLLQQSNFNHRAIVDKGVLKEACSTLLTTFFKNLRANKKSTN saTadA (D108N)-as used in pNMG-346:
                                                                (SEQ ID NO: 433)
GSHMTNDIYFMTLAIEEAKKAAQLGEVPIGAIITKDDEVIARAHNLRETLQQPTAHAE
HIAIERAAKVLGSWRLEGCTLYVTLEPCVMCAGTIVMSRIPRVVYGADNPKGGCSGS
LMNLLQQSNFNHRAIVDKGVLKEACSTLLTTFFKNLRANKKSTN saTadA (D107A_D108N)-as used in pNMG-347:
                                                                (SEQ ID NO: 434)
GSHMTNDIYFMTLAIEEAKKAAQLGEVPIGAIITKDDEVIARAHNLRETLQQPTAHAE
HIAIERAAKVLGSWRLEGCTLYVTLEPCVMCAGTIVMSRIPRVVYGAANPKGGCSGS
LMNLLQQSNFNHRAIVDKGVLKEACSTLLTTFFKNLRANKKSTN saTadA (G26P_D107A_D108N)-as used in pNMG-348:
                                                                (SEQ ID NO: 435)
GSHMTNDIYFMTLAIEEAKKAAQLPEVPIGAIITKDDEVIARAHNLRETLQQPTAHAE
HIAIERAAKVLGSWRLEGCTLYVTLEPCVMCAGTIVMSRIPRVVYGAANPKGGCSGS
LMNLLQQSNFNHRAIVDKGVLKEACSTLLTTFFKNLRANKKSTN saTadA (G26P_D107A_D108N_S142A)-as used in pNMG-349:
                                                                (SEQ ID NO: 436)
GSHMTNDIYFMTLAIEEAKKAAQLPEVPIGAIITKDDEVIARAHNLRETLQQPTAHAE
HIAIERAAKVLGSWRLEGCTLYVTLEPCVMCAGTIVMSRIPRVVYGAANPKGGCSGS
LMNLLQQSNFNHRAIVDKGVLKEACATLLTTFFKNLRANKKSTN saTadA (D107A_D108N_S142A)-as used in pNMG-350:
                                                                (SEQ ID NO: 437)
GSHMTNDIYFMTLAIEEAKKAAQLGEVPIGAIITKDDEVIARAHNLRETLQQPTAHAE
HIAIERAAKVLGSWRLEGCTLYVTLEPCVMCAGTIVMSRIPRVVYGAANPKGGCSGS
LMNLLQQSNFNHRAIVDKGVLKEACATLLTTFFKNLRANKKSTN ecTadA (P48S)-mutation from evolution #6
                                                                (SEQ ID NO: 672)
SEVEFSHEYWMRHALTLAKRAWDEREVPVGAVLVHNNRVIGEGWNRSIGRHDPTA
HAEIMALRQGGLVMQNYRLIDATLYVTLEPCVMCAGAMIHSRIGRVVFGARDAKTG
AAGSLMDVLHHPGMNHRVEITEGILADECAALLSDFFRMRRQEIKAQKKAQSSTD ecTadA (P48T)-mutation from evolution #6
                                                                (SEQ ID NO: 673)
SEVEFSHEYWMRHALTLAKRAWDEREVPVGAVLVHNNRVIGEGWNRTIGRHDPTA
HAEIMALRQGGLVMQNYRLIDATLYVTLEPCVMCAGAMIHSRIGRVVFGARDAKTG
AAGSLMDVLHHPGMNHRVEITEGILADECAALLSDFFRMRRQEIKAQKKAQSSTD ecTadA (P48A)-mutation from evolution #6
                                                                (SEQ ID NO: 674)
SEVEFSHEYWMRHALTLAKRAWDEREVPVGAVLVHNNRVIGEGWNRAIGRHDPTA
HAEIMALRQGGLVMQNYRLIDATLYVTLEPCVMCAGAMIHSRIGRVVFGARDAKTG
AAGSLMDVLHHPGMNHRVEITEGILADECAALLSDFFRMRRQEIKAQKKAQSSTD ecTadA (A142N)-mutation from evolution #6
                                                                (SEQ ID NO: 675)
SEVEFSHEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGARDAKTG
AAGSLMDVLHHPGMNHRVEITEGILADECNALLSDFFRMRRQEIKAQKKAQSSTD ecTadA (W23R)-mutation from evolution #7
                                                                (SEQ ID NO: 676)
SEVEFSHEYWMRHALTLAKRARDEREVPVGAVLVHNNRVIGEGWNRPIGRHDPTA
HAEIMALRQGGLVMQNYRLIDATLYVTLEPCVMCAGAMIHSRIGRVVFGARDAKTG
AAGSLMDVLHHPGMNHRVEITEGILADECAALLSDFFRMRRQEIKAQKKAQSSTD ecTadA (W23L)-mutation from evolution #7
                                                                (SEQ ID NO: 677)
SEVEFSHEYWMRHALTLAKRALDEREVPVGAVLVHNNRVIGEGWNRPIGRHDPTAH
AEIMALRQGGLVMQNYRLIDATLYVTLEPCVMCAGAMIHSRIGRVVFGARDAKTGA
AGSLMDVLHHPGMNHRVEITEGILADECAALLSDFFRMRRQEIKAQKKAQSSTD ecTadA (R152P)-mutation from evolution #7
                                                                (SEQ ID NO: 678)
SEVEFSHEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGARDAKTG
AAGSLMDVLHHPGMNHRVEITEGILADECAALLSDFFRMPRQEIKAQKKAQSSTD ecTadA (R152H)-mutation from evolution #7
```

-continued (SEQ ID NO: 679)
SEVEFSHEYWMRHALTLAKRAWDEREVPVGAVLVHNNRVIGEGWNRPIGRHDPTA
HAEIMALRQGGLVMQNYRLIDATLYVTLEPCVMCAGAMIHSRIGRVVFGARDAKTG
AAGSLMDVLHHPGMNHRVEITEGILADECAALLSDFFRMHRQEIKAQKKAQSSTD ecTadA (L84F, A106V, D108N, H123Y, D147Y, E155V, I156F)-
mutations from pNMG 371

(SEQ ID NO: 680)
SEVEFSHEYWMRHALTLAKRAWDEREVPVGAVLVHNNRVIGEGWNRPIGRHDPTA
HAEIMALRQGGLVMQNYRLIDATLYVTFEPCVMCAGAMIHSRIGRVVFGVRNAKTG
AAGSLMDVLHYPGMNHRVEITEGILADECAALLSYFFRMRRQVFKAQKKAQSSTD ecTadA (H36L, R51L, L84F, A106V, D108N, H123Y, S146C, D147Y,
E155V, I156F, K157N)-mutations from pNMG 477

(SEQ ID NO: 681)
SEVEFSHEYWMRHALTLAKRAWDEREVPVGAVLVLNNRVIGEGWNRPIGLHDPTA
HAEIMALRQGGLVMQNYRLIDATLYVTFEPCVMCAGAMIHSRIGRVVFGVRNAKTG
AAGSLMDVLHYPGMNHRVEITEGILADECAALLCYFFRMRRQVFNAQKKAQSSTD ecTadA (H36L, P48S, R51L, L84F, A106V, D108N, H123Y, S146C, D147Y,
E155V, I156F, K157N)-mutations from pNMG 576

(SEQ ID NO: 682)
SEVEFSHEYWMRHALTLAKRAWDEREVPVGAVLVLNNRVIGEGWNRSIGLHDPTA
HAEIMALRQGGLVMQNYRLIDATLYVTFEPCVMCAGAMIHSRIGRVVFGVRNAKTG
AAGSLMDVLHYPGMNHRVEITEGILADECAALLCYFFRMRRQVFNAQKKAQSSTD ecTadA (H36L, P48A, R51L, L84F, A106V, D108N, H123Y, S146C, D147Y,
E155V, I156F, K157N)-mutations from pNMG 586

(SEQ ID NO: 683)
SEVEFSHEYWMRHALTLAKRAWDEREVPVGAVLVLNNRVIGEGWNRAIGLHDPTA
HAEIMALRQGGLVMQNYRLIDATLYVTFEPCVMCAGAMIHSRIGRVVFGVRNAKTG
AAGSLMDVLHYPGMNHRVEITEGILADECAALLCYFFRMRRQVFNAQKKAQSSTD ecTadA (W23L, H36L, P48A, R51L, L84F, A106V, D108N, H123Y, S146C, D147Y,
R152P, E155V, I156F, K157N)-mutations from pNMG 616

(SEQ ID NO: 684)
SEVEFSHEYWMRHALTLAKRALDEREVPVGAVLVLNNRVIGEGWNRAIGLHDPTAH
AEIMALRQGGLVMQNYRLIDATLYVTFEPCVMCAGAMIHSRIGRVVFGVRNAKTGA
AGSLMDVLHYPGMNHRVEITEGILADECAALLCYFFRMPRQVFNAQKKAQSSTD

Cas9 Domains of Nucleobase Editors

In some aspects, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain, or a Cas9 nickase. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth in SEQ ID NOs: 108-357. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in SEQ ID NOs: 108-357. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth in SEQ ID NOs: 108-357. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 108-357.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth in SEQ ID NO: 52, or a corresponding mutation in any of the amino acid sequences provided in SEQ ID NOs: 108-357, wherein X is any amino acid change. In some embodiments, the nuclease-inactive dCas9 domain comprises a D10A mutation and a H840A mutation of the amino acid sequence set forth in SEQ ID NO: 52, or a corresponding mutation in any of the amino acid sequences provided in SEQ ID NOs: 108-357. As one example, a nuclease-inactive Cas9 domain comprises the amino acid sequence set forth in SEQ ID NO: 54 (Cloning vector pPlatTET-gRNA2, Accession No. BAV54124).
MDKKYSIGLAIGTNSVGWAVIT-DEYKVPSKKFKVLGNTDRHSIKKNLIGALLFDS GE TAEATRLKRTARRRYTRRKNRICYLQEIFSNE-MAKVDDSFFHRLEESFLVEEDKKHE RHPIFGNIVDEVAYHEKYPTIYHLRKKLVD-STDKADLRLIYLALAHMIKFRGHFLIEG DLNPDNSDVDKLFIQLVQTYNQLFEENPI-NASGVDAKAILSARLSKSRRLENLIAQLP GEK-KNGLFGNLIALSLGLTPNFKSNFDLAEDAKLQLSKD-TYDDDLDNLLAQIGDQYA DLFLAAKNLSDAILLSDILRVNTEITKAPLSASMIKRY- DEHHQDLTLLKALVRQQLPE KYKEIFFDQSKNG-
YAGYIDGGASQEEFYKFIKPILEKMDGTEELL-
VKLNREDLLRKQR
TFDNGSIPHQIHLGELHAILRRQEDFYPFLKDN-
REKIEKILTFRIPYYVGPLARGNSRFA WMTRK-
SEETITPWNFEEVVDKGASAQSFIERMTNFDKNLP-
NEKVLPKHSLLYEYFTV
YNELTKVKYVTEGMRKPAFLSGEQKKAIVDLL-
FKTNRKVTVKQLKEDYFKKIECFD SVEISGVEDRF-
NASLGTYHDLLKIIKDKDFLDNEENEDILEDI-
VLTLTLFEDREMIEERL
KTYAHLFDDKVMKQLKRRRYTGWGRLSRKLIN-
GIRDKQSGKTILDFLKSDGFANRN FMQLIHDD-
SLTFKEDIQKAQVSGQGDSLHEHIANLAGSPAIK-
KGILQTVKVVDELVK
VMGRHKPENIVIEMARENQTTQKGQKNSR-
ERMKRIEEGIKELGSQILKEHPVENTQL QNEKLY-
LYYLQNGRDMYVDQELDINRLSDYDV-
DAIVPQSFLKDDSIDNKVLTRSDK
NRGKSDNVPSEEVVKKMKNYWRQLLNAK-
LITQRKFDNLTKAERGGLSELDKAGFIK RQLVE-
TRQITKHVAQILDSRMNTKYDENDKLIREVKVITLK-
SKLVSDFRKDFQFYKV
REINNYHHAHDAYLNAVVGTALIK-
KYPKLESEFVYGDYKVYDVRKMIAKSEQEIGK
ATAKYFFYSNIMNFFKTEITLANGEIRKRPLIETNGET-
GEIVWDKGRDFATVRKVLSM PQVNIVKKTE-
VQTGGFSKESILPKRN-
SDKLIARKKDWDPKKYGGFDSPTVAYSVLVV
AKVEKGKSKKLKSVKELLGITIMERSSFEKNPID-
FLEAKGYKEVKKDLIIKLPKYSLFE LENGRKRMLA-
SAGELQKGNELALPSKYVNFLYLASHYEKLKGSPED-
NEQKQLFVEQ
HKHYLDEIIEQISEFSKRVILADANLDKVL-
SAYNKHRDKPIREQAENIIHLFTLTNLGA PAAF-
KYFDTTIDRKRYTSTKEVLDATLIHQSITGLY-
ETRIDLSQLGGD (SEQ ID NO: 54; see, e.g., Qi et al., "Repurposing CRISPR as an RNA-guided platform for sequence-specific control of gene expression." *Cell.* 2013; 152(5):1173-83, the entire contents of which are incorporated herein by reference).

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference). In some embodiments the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 108-357. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 108-357.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840 of SEQ ID NO: 52, or a mutation in any of SEQ ID NOs: 108-357. As one example, a Cas9 nickase may comprise the amino acid sequence as set forth in SEQ ID NO: 35. In some embodiments, the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10 of SEQ ID NO: 52, or a corresponding mutation in any of SEQ ID NOs: 108-357. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

Cas9 Domains with Reduced PAM Exclusivity

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region, where the "N" in "NGG" is adenine (A), thymine (T), guanine (G), or cytosine (C), and the G is guanine. This may limit the ability to edit desired bases within a genome. In some embodiments, the base editing fusion proteins provided herein need to be positioned at a precise location, for example, where a target base is within a 4 base region (e.g., a "deamination window"), which is approximately 15 bases upstream of the PAM. See Komor, A. C., et al., "Programmable editing of a target base in genomic DNA without double-stranded DNA cleavage" *Nature* 533, 420-424 (2016), the entire contents of which are hereby incorporated by reference. In some embodiments, the deamination window is within a 2, 3, 4, 5, 6, 7, 8, 9, or 10 base region. In some embodiments, the deamination window is 5, 6, 7, 8, 9, 10, 11, 12, 13, 14, 15, 16, 17, 18, 19, 20, 21, 22, 23, 24, or 25 bases upstream of the PAM. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises the amino acid sequence SEQ ID NO: 55. In some embodiments, the SaCas9 comprises a N579X mutation of SEQ ID NO: 55, or a corresponding mutation in any of the amino acid sequences provided in SEQ ID NOs: 108-357, wherein X is any amino acid except for N. In some embodiments, the SaCas9 comprises a N579A mutation of SEQ ID NO: 55, or a corresponding mutation in any of the amino acid sequences provided in SEQ ID NOs: 108-357.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence, where N=A, T, C, or G, and R=A or G. In some embodiments, the SaCas9 domain comprises one or more of E781X, N967X, and R1014X mutation of SEQ ID NO: 55, or a corresponding mutation in any of the amino acid sequences provided in SEQ ID NOs: 108-357, wherein X is any amino acid. In some embodiments, the SaCas9 domain comprises one or more of a E781K, a N967K, and a R1014H mutation of SEQ ID NO: 55, or one or more corresponding mutation in any of the amino acid sequences provided in SEQ ID NOs: 108-357. In some embodiments, the SaCas9 domain comprises a E781K, a N967K, or a R1014H mutation of SEQ ID NO: 55, or corresponding mutations in any of the amino acid sequences provided in SEQ ID NOs: 108-357.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 55-57. In some embodiments, the Cas9 domain of any of the fusion proteins provided herein comprises the amino acid sequence of any one of SEQ ID NOs: 55-57. In some embodiments, the Cas9 domain of any of the fusion proteins provided herein consists of the amino acid sequence of any one of SEQ ID NOs: 55-57.

```
Exemplary SaCas9 sequence
                                    (SEQ ID NO: 55)
KRNYILGLDIGITSVGYGIIDYETRDVIDAGVRLFKEANVENNEGRRSK

RGARRLKRRRRHRIQRVKKLLFDYNLLTDHSELSGINPYEARVKGLSQKL

SEEEFSAALLHLAKRRGVHNVNEVEEDTGNELSTKEQISRNSKALEEKYV

AELQLERLKKDGEVRGSINRFKTSDYVKEAKQLLKVQKAYHQLDQSFIDT

YIDLLETRRTYYEGPGEGSPFGWKDIKEWYEMLMGHCTYFPEELRSVKYA

YNADLYNALNDLNNLVITRDENEKLEYYEKFQIIENVFKQKKKPTLKQIA

KEILVNEEDIKGYRVTSTGKPEFTNLKVYHDIKDITARKEIIENAELLDQ

IAKILTIYQSSEDIQEELTNLNSELTQEEIEQISNLKGYTGTHNLSLKAI

NLILDELWHTNDNQIAIFNRLKLVPKKVDLSQQKEIPTTLVDDFILSPVV

KRSFIQSIKVINAIIKKYGLPNDIIIELAREKNSKDAQKMINEMQKRNRQ

TNERIEEIIRTTGKENAKYLIEKIKLHDMQEGKCLYSLEAIPLEDLLNNP

FNYEVDHIIPRSVSFDNSFNNKVLVKQEENSKKGNRTPFQYLSSSDSKIS

YETFKKHILNLAKGKGRISKTKKEYLLEERDINRFSVQKDFINRNLVDTR

YATRGLMNLLRSYFRVNNLDVKVKSINGGFTSFLRRKWKFKKERNKGYKH

HAEDALIIANADFIFKEWKKLDKAKKVMENQMFEEKQAESMPEIETEQEY

KEIFITPHQIKHIKDFKDYKYSHRVDKKPNRELINDTLYSTRKDDKGNTL

IVNNLNGLYDKDNDKLKKLINKSPEKLLMYHHDPQTYQKLKLIMEQYGDE

KNPLYKYYEETGNYLTKYSKKDNGPVIKKIKYYGNKLNAHLDITDDYPNS

RNKVVKLSLKPYRFDVYLDNGVYKFVTVKNLDVIKKENYYEVNSKCYEEA

KKLKKISNQAEFIASFYNNDLIKINGELYRVIGVNNDLLNRIEVNMIDIT

YREYLENMNDKRPPRIIKTIASKTQSIKKYSTDILGNLYEVKSKKHPQII

KKG
```
Residue N579 of SEQ ID NO: 55, which is underlined and in bold, may be mutated (e.g., to a A579) to yield a SaCas9 nickase.

```
Exemplary SaCas9n sequence
                                    (SEQ ID NO: 56)
KRNYILGLDIGITSVGYGIIDYETRDVIDAGVRLFKEANVENNEGRRSK

RGARRLKRRRRHRIQRVKKLLFDYNLLTDHSELSGINPYEARVKGLSQKL

SEEEFSAALLHLAKRRGVHNVNEVEEDTGNELSTKEQISRNSKALEEKYV

AELQLERLKKDGEVRGSINRFKTSDYVKEAKQLLKVQKAYHQLDQSFIDT

YIDLLETRRTYYEGPGEGSPFGWKDIKEWYEMLMGHCTYFPEELRSVKYA

YNADLYNALNDLNNLVITRDENEKLEYYEKFQIIENVFKQKKKPTLKQIA

KEILVNEEDIKGYRVTSTGKPEFTNLKVYHDIKDITARKEIIENAELLDQ

IAKILTIYQSSEDIQEELTNLNSELTQEEIEQISNLKGYTGTHNLSLKAI

NLILDELWHTNDNQIAIFNRLKLVPKKVDLSQQKEIPTTLVDDFILSPVV

KRSFIQSIKVINAIIKKYGLPNDIIIELAREKNSKDAQKMINEMQKRNRQ

TNERIEEIIRTTGKENAKYLIEKIKLHDMQEGKCLYSLEAIPLEDLLNNP

FNYEVDHIIPRSVSFDNSFNNKVLVKQEEASKKGNRTPFQYLSSSDSKIS

YETFKKHILNLAKGKGRISKTKKEYLLEERDINRFSVQKDFINRNLVDTR

YATRGLMNLLRSYFRVNNLDVKVKSINGGFTSFLRRKWKFKKERNKGYKH

HAEDALIIANADFIFKEWKKLDKAKKVMENQMFEEKQAESMPEIETEQEY

KEIFITPHQIKHIKDFKDYKYSHRVDKKPNRELINDTLYSTRKDDKGNTL

IVNNLNGLYDKDNDKLKKLINKSPEKLLMYHHDPQTYQKLKLIMEQYGDE

KNPLYKYYEETGNYLTKYSKKDNGPVIKKIKYYGNKLNAHLDITDDYPNS

RNKVVKLSLKPYRFDVYLDNGVYKFVTVKNLDVIKKENYYEVNSKCYEEA

KKLKKISNQAEFIASFYNNDLIKINGELYRVIGVNNDLLNRIEVNMIDIT

YREYLENMNDKRPPRIIKTIASKTQSIKKYSTDILGNLYEVKSKKHPQII

KKG.
```
Residue A579 of SEQ ID NO: 56, which can be mutated from N579 of SEQ ID NO: 55 to yield a SaCas9 nickase, is underlined and in bold.

-continued

Exemplary SaKKH Cas9
(SEQ ID NO: 57)
KRNYILGLDIGITSVGYGIIDYETRDVIDAGVRLFKEANVENNEGRRSK

RGARRLKRRRRHRIQRVKKLLFDYNLLTDHSELSGINPYEARVKGLSQKL

SEEEFSAALLHLAKRRGVHNVNEVEEDTGNELSTKEQISRNSKALEEKYV

AELQLERLKKDGEVRGSINRFKTSDYVKEAKQLLKVQKAYHQLDQSFIDT

YIDLLETRRTYYEGPGEGSPFGWKDIKEWYEMLMGHCTYFPEELRSVKYA

YNADLYNALNDLNNLVITRDENEKLEYYEKFQIIENVFKQKKKPTLKQIA

KEILVNEEDIKGYRVTSTGKPEFTNLKVYHDIKDITARKEIIENAELLDQ

IAKILTIYQSSEDIQEELTNLNSELTQEEIEQISNLKGYTGTHNLSLKAI

NLILDELWHTNDNQIAIFNRLKLVPKKVDLSQQKEIPTTLVDDFILSPVV

KRSFIQSIKVINAIIKKYGLPNDIIIELAREKNSKDAQKMINEMQKRNRQ

TNERIEEIIRTTGKENAKYLIEKIKLHDMQEGKCLYSLEAIPLEDLLNNP

FNYEVDHIIPRSVSFDNSFNNKVLVKQEEASKKGNRTPFQYLSSSDSKIS

YETFKKHILNLAKGKGRISKTKKEYLLEERDINRFSVQKDFINRNLVDTR

YATRGLMNLLRSYFRVNNLDVKVKSINGGFTSFLRRKWKFKKERNKGYKH

HAEDALIIANADFIFKEWKKLDKAKKVMENQMFEEKQAESMPEIETEQEY

KEIFITPHQIKHIKDFKDYKYSHRVDKKPNR*K*LINDTLYSTRKDDKGNTL

IVNNLNGLYDKDNDKLKKLINKSPEKLLMYHHDPQTYQKLKLIMEQYGDE

KNPLYKYYEETGNYLTKYSKKDNGPVIKKIKYYGNKLNAHLDITDDYPNS

RNKVVKLSLKPYRFDVYLDNGVYKFVTVKNLDVIKKENYYEVNSKCYEEA

KKLKKISNQAEFIASFY*K*NDLIKINGELYRVIGVNNDLLNRIEVNMIDIT

YREYLENMNDKRPP*H*IIKTIASKTQSIKKYSTDILGNLYEVKSKKHPQII

KKG.

Residue A579 of SEQ ID NO: 57, which can be mutated from N579 of SEQ ID NO: 55 to yield a SaCas9 nickase, is underlined and in bold. Residues K781, K967, and H1014 of SEQ ID NO: 57, which can be mutated from E781, N967, and R1014 of SEQ ID NO: 55 to yield a SaKKH Cas9 are underlined and in italics.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises the amino acid sequence SEQ ID NO: 58. In some embodiments, the SpCas9 comprises a D9X mutation of SEQ ID NO: 58, or a corresponding mutation in any of the amino acid sequences provided in SEQ ID NOs: 108-357, wherein X is any amino acid except for D. In some embodiments, the SpCas9 comprises a D9A mutation of SEQ ID NO: 58, or a corresponding mutation in any of the amino acid sequences provided in SEQ ID NOs: 108-357. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having a NGG, a NGA, or a NGCG PAM sequence. In some embodiments, the SpCas9 domain comprises one or more of a D1134X, a R1334X, and a T1336X mutation of SEQ ID NO: 58, or a corresponding mutation in any of the amino acid sequences provided in SEQ ID NOs: 108-35, wherein X is any amino acid. In some embodiments, the SpCas9 domain comprises one or more of a D1134E, R1334Q, and T1336R mutation of SEQ ID NO: 58, or a corresponding mutation in any of the amino acid sequences provided in SEQ ID NOs: 108-35. In some embodiments, the SpCas9 domain comprises a D1134E, a R1334Q, and a T1336R mutation of SEQ ID NO: 58, or corresponding mutations in any of the amino acid sequences provided in SEQ ID NOs: 108-35. In some embodiments, the SpCas9 domain comprises one or more of a D1134X, a R1334X, and a T1336X mutation of SEQ ID NO: 58, or a corresponding mutation in any of the amino acid sequences provided in SEQ ID NOs: 108-35, wherein X is any amino acid. In some embodiments, the SpCas9 domain comprises one or more of a D1134V, a R1334Q, and a T1336R mutation of SEQ ID NO: 58, or a corresponding mutation in any of the amino acid sequences provided in SEQ ID NOs: 108-35. In some embodiments, the SpCas9 domain comprises a D1134V, a R1334Q, and a T1336R mutation of SEQ ID NO: 58, or corresponding mutations in any of the amino acid sequences provided in SEQ ID NOs: 108-35. In some embodiments, the SpCas9 domain comprises one or more of a D1134X, a G1217X, a R1334X, and a T1336X mutation of SEQ ID NO: 58, or a corresponding mutation in any of the amino acid sequences provided in SEQ ID NOs: 108-35, wherein X is any amino acid. In some embodiments, the SpCas9 domain comprises one or more of a D1134V, a G1217R, a R1334Q, and a T1336R mutation of SEQ ID NO: 58, or a corresponding mutation in any of the amino acid sequences provided in SEQ ID NOs: 108-35. In some embodiments, the SpCas9 domain comprises a D1134V, a G1217R, a R1334Q, and a T1336R mutation of SEQ ID NO: 58, or corresponding mutations in any of the amino acid sequences provided in SEQ ID NOs: 108-35.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 58-62. In some embodiments, the Cas9 domain of any of the fusion proteins provided herein comprises the amino acid sequence of any one of SEQ ID NOs: 58-62. In some embodiments, the Cas9 domain of any of the fusion proteins provided herein consists of the amino acid sequence of any one of SEQ ID NOs: 58-62.

Exemplary SpCas9
(SEQ ID NO: 58)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

```
-continued
LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary SpCas9n
                                    (SEQ ID NO: 59)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary SpEQR Cas9
                                    (SEQ ID NO: 60)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFESPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKQYRSTKEVLDATLIHQS

ITGLYETRIDLSQLGGD
```

Residues E1134, Q1334, and R1336 of SEQ ID NO: 60, which can be mutated from D1134, R1334, and T1336 of SEQ ID NO: 58 to yield a SpEQR Cas9, are underlined and in bold.

Exemplary SpVQR Cas9

(SEQ ID NO: 61)

DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVETSGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDHIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFVSPTVAYSVLVVAKVEK
GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKQYRSTKEVLDATLIHQS
ITGLYETRIDLSQLGGD

Residues V1134, Q1334, and R1336 of SEQ ID NO: 61, which can be mutated from D1134, R1334, and T1336 of SEQ ID NO: 58 to yield a SpVQR Cas9, are underlined and in bold.

Exemplary SpVRER Cas9

(SEQ ID NO: 62)

DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVETSGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDHIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFVSPTVAYSVLVVAKVEK
GKSKKLKSVKELLGITIMERSSFEKNPIDFLEAKGYKEVKKDLIIKLPKY
SLFELENGRKRMLASARELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKEYRSTKEVLDATLIHQS
ITGLYETRIDLSQLGGD

Residues V1134, R1217, Q1334, and R1336 of SEQ ID NO: 62, which can be mutated from D1134, G1217, R1334, and T1336 of SEQ ID NO: 58 to yield a SpVRER Cas9, are underlined and in bold.

High Fidelity Cas9 Domains

Some aspects of the disclosure provide high fidelity Cas9 domains of the nucleobase editors provided herein. In some embodiments, high fidelity Cas9 domains are engineered Cas9 domains comprising one or more mutations that decrease electrostatic interactions between the Cas9 domain and the sugar-phosphate backbone of DNA, as compared to a corresponding wild-type Cas9 domain. Without wishing to be bound by any particular theory, high fidelity Cas9 domains that have decreased electrostatic interactions with the sugar-phosphate backbone of DNA may have less off-target effects. In some embodiments, the Cas9 domain (e.g., a wild type Cas9 domain) comprises one or more mutations that decreases the association between the Cas9 domain and the sugar-phosphate backbone of DNA. In some embodiments, a Cas9 domain comprises one or more mutations that decreases the association between the Cas9 domain and the sugar-phosphate backbone of DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, or more.

In some embodiments, any of the Cas9 fusion proteins provided herein comprise one or more of N497X, R661X, Q695X, and/or Q926X mutation of the amino acid sequence provided in SEQ ID NO: 52, or a corresponding mutation in any of the amino acid sequences provided in SEQ ID NOs: 108-357, wherein X is any amino acid. In some embodiments, any of the Cas9 fusion proteins provided herein comprise one or more of N497A, R661A, Q695A, and/or Q926A mutation of the amino acid sequence provided in SEQ ID NO: 52, or a corresponding mutation in any of the amino acid sequences provided in SEQ ID NOs: 108-357. In some embodiments, the Cas9 domain comprises a D10A mutation of the amino acid sequence provided in SEQ ID NO: 52, or a corresponding mutation in any of the amino acid sequences provided in SEQ ID NOs: 108-357. In some embodiments, the Cas9 domain (e.g., of any of the fusion proteins provided herein) comprises the amino acid sequence as set forth in SEQ ID NO: 62. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." Nature 529, 490-495 (2016); and Slaymaker, I. M., et al. "Rationally engineered Cas9 nucleases with improved specificity." Science 351, 84-88 (2015); the entire contents of each are incorporated herein by reference.

It should be appreciated that any of the base editors provided herein, for example, any of the adenosine deaminase base editors provided herein, may be converted into high fidelity base editors by modifying the Cas9 domain as described herein to generate high fidelity base editors, for example, a high fidelity adenosine base editor. In some embodiments, the high fidelity Cas9 domain is a dCas9 domain. In some embodiments, the high fidelity Cas9 domain is a nCas9 domain.

```
High Fidelity Cas9 domain where mutations relative
to Cas9 of SEQ ID NO: 10 are shown in bold and
underlines
                                        (SEQ ID NO: 63)
DKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDKA

DLRLIYLALAHMIKFRGHFLIEGDLNPDNSDVDKLFIQLVQTYNQLFEEN

PINASGVDAKAILSARLSKSRRLENLIAQLPGEKKNGLFGNLIALSLGLT

PNFKSNFDLAEDAKLQLSKDTYDDDLDNLLAQIGDQYADLFLAAKNLSDA

ILLSDILRVNTEITKAPLSASMIKRYDEHHQDLTLLKALVRQQLPEKYKE

IFFDQSKNGYAGYIDGGASQEEFYKFIKPILEKMDGTEELLVKLNREDLL

RKQRTFDNGSIPHQIHLGELHAILRRQEDFYPFLKDNREKIEKILTFRIP

YYVGPLARGNSRFAWMTRKSEETITPWNFEEVVDKGASAQSFIERMTAFD

KNLPNEKVLPKHSLLYEYFTVYNELTKVKYVTEGMRKPAFLSGEQKKAIV

DLLFKTNRKVTVKQLKEDYFKKIECFDSVEISGVEDRFNASLGTYHDLLK

IIKDKDFLDNEENEDILEDIVLTLTLFEDREMIEERLKTYAHLFDDKVMK

QLKRRRYTGWGALSRKLINGIRDKQSGKTILDFLKSDGFANRNFMALIHD

DSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEH

PVENTQLQNEKLYLYYLQNGRDMYVDQELDINRLSDYDVDHIVPQSFLKD

DSIDNKVLTRSDKNRGKSDNVPSEEVVKKMKNYWRQLLNAKLITQRKFDN

LTKAERGGLSELDKAGFIKRQLVETRAITKHVAQILDSRMNTKYDENDKL

IREVKVITLKSKLVSDFRKDFQFYKVREINNYHHAHDAYLNAVVGTALIK

KYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTE

VQTGGFSKESILPKRNSDKLIARKKDWDPKKYGGFDSPTVAYSVLVVAKV

EKGKSKKLKSVKELLGITIMERSSFEKNPIDFLEAKGYKEVKKDLIIKLP

KYSLFELENGRKRMLASAGELQKGNELALPSKYVNFLYLASHYEKLKGSP

EDNEQKQLFVEQHKHYLDEIIEQISEFSKRVILADANLDKVLSAYNKHRD

KPIREQAENIIHLFTLTNLGAPAAFKYFDTTIDRKRYTSTKEVLDATLIH

QSITGLYETRIDLSQLGGD
```

Nucleic Acid Programmable DNA Binding Proteins

Some aspects of the disclosure provide nucleic acid programmable DNA binding proteins, which may be used to guide a protein, such as a base editor, to a specific nucleic acid (e.g., DNA or RNA) sequence. Nucleic acid programmable DNA binding proteins include, without limitation, Cas9 (e.g., dCas9 and nCas9), CasX, CasY, Cpf1, C2c1, C2c2, C2C3, and Argonaute. One example of an nucleic acid programmable DNA-binding protein that has different PAM specificity than Cas9 is Clustered Regularly Interspaced Short Palindromic Repeats from Prevotella and Francisella 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are known in the art and have been described previously, for example Yamano et al., "Crystal structure of Cpf1 in complex with guide RNA and target DNA." Cell (165) 2016, p. 949-962; the entire contents of which is hereby incorporated by reference.

Also useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., Cell, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in Francisella novicida Cpf1 (SEQ ID NO: 382) inactivates Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A in SEQ ID NO: 376. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 376-382. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 376-382, and comprises mutations corresponding to D917A, E1006A, D1255A, D917A/E1006A, D917A/D1255A, E1006A/D1255A, or D917A/E1006A/D1255A in SEQ ID NO: 376. In some embodiments, the dCpf1 comprises an amino acid sequence of any one SEQ ID NOs: 376-382. It should be appreciated that Cpf1 from other bacterial species may also be used in accordance with the present disclosure.

```
Wild type Francisella novicida Cpf1 (SEQ ID NO:
376) (D917, E1006, and D1255 are bolded and under-
lined)
                                       (SEQ ID NO: 376)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGR

PNLHTLYWKALFDERNLQDVVYKLNGEAELFYRKQSIPKKITHPAKEAIA

NKNKDNPKKESVFEYDLIKDKRFTEDKFFFHCPITINFKSSGANKFNDEI

NLLLKEKANDVHILSIDRGERHLAYYTLVDGKGNIIKQDTFNIIGNDRMK

TNYHDKLAAIEKDRDSARKDWKKINNIKEMKEGYLSQVVHEIAKLVIEYN

AIVVFEDLNFGFKRGRFKVEKQVYQKLEKMLIEKLNYLVFKDNEFDKTGG

VLRAYQLTAPFETFKKMGKQTGIIYYVPAGFTSKICPVTGFVNQLYPKYE

SVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESD

KKFFAKLTSVLNTILQMRNSKTGTELDYLISPVADVNGNFFDSRQAPKNM

PQDADANGAYHIGLKGLMLLGRIKNNQEGKKLNLVIKNEEYFEFVQNRNN

Francisella novicida Cpf1 D917A (SEQ ID NO: 377)
(A917, E1006, and D1255 are bolded and underlined)
                                       (SEQ ID NO: 377)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMEDEIAQNKDNLAQ

ISIKYQNQGKKDLLQASAEDDVKAIKDLLDQTNNLLHKLKIFHISQSEDK

ANILDKDEHFYLVFEECYFELANIVPLYNKIRNYITQKPYSDEKFKLNFE

NSTLANGWDKNKEPDNTAILFIKDDKYYLGVMNKKNNKIFDDKAIKENKG

EGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSID

EFYREVENQGYKLTFENISESYIDSVVNQGKLYLFQIYNKDFSAYSKGRP

NLHTLYWKALFDERNLQDVVYKLNGEAELFYRKQSIPKKITHPAKEAIAN

KNKDNPKKESVFEYDLIKDKRFTEDKFFFHCPITINFKSSGANKFNDEIN

LLLKEKANDVHILSIARGERHLAYYTLVDGKGNIIKQDTFNIIGNDRMKT

NYHDKLAAIEKDRDSARKDWKKINNIKEMKEGYLSQVVHEIAKLVIEYNA

IVVFEDLNFGFKRGRFKVEKQVYQKLEKMLIEKLNYLVFKDNEFDKTGGV

LRAYQLTAPFETFKKMGKQTGIIYYVPAGFTSKICPVTGFVNQLYPKYES

VSKSQEFFSKFDKICYNLDKGYFEFSFDYKNFGDKAAKGKWTIASFGSRL

INFRNSDKNHNWDTREVYPTKELEKLLKDYSIEYGHGECIKAAICGESDK

KFFAKLTSVLNTILQMRNSKTGTELDYLISPVADVNGNFFDSRQAPKNMP

QDADANGAYHIGLKGLMLLGRIKNNQEGKKLNLVIKNEEYFEFVQNRNN

Francisella novicida Cpf1 E1006A (SEQ ID NO: 378)
(D917, A1006, and D1255 are bolded and underlined)
                                       (SEQ ID NO: 378)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF
```

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGR

PNLHTLYWKALFDERNLQDVVYKLNGEAELFYRKQSIPKKITHPAKEAIA

NKNKDNPKKESVFEYDLIKDKRFTEDKFFFHCPITINFKSSGANKFNDEI

NLLLKEKANDVHILSIDRGERHLAYYTLVDGKGNIIKQDTFNIIGNDRMK

TNYHDKLAAIEKDRDSARKDWKKINNIKEMKEGYLSQVVHEIAKLVIEYN

AIVVFADLNFGFKRGRFKVEKQVYQKLEKMLIEKLNYLVFKDNEFDKTGG

VLRAYQLTAPFETFKKMGKQTGIIYYVPAGFTSKICPVTGFVNQLYPKYE

SVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESD

KKFFAKLTSVLNTILQMRNSKTGTELDYLISPVADVNGNFFDSRQAPKNM

PQDADANGAYHIGLKGLMLLGRIKNNQEGKKLNLVIKNEEYFEFVQNRNN

*Francisella novicida* Cpf1 D1255A (SEQ ID NO: 379)
(D917, E1006, and A1255 are bolded and underlined)

(SEQ ID NO: 379)

MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMEDEIAQNKDNLAQ

ISIKYQNQGKKDLLQASAEDDVKAIKDLLDQTNNLLHKLKIFHISQSEDK

ANILDKDEHFYLVFEECYFELANIVPLYNKIRNYITQKPYSDEKFKLNFE

NSTLANGWDKNKEPDNTAILFIKDDKYYLGVMNKKNNKIFDDKAIKENKG

EGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSID

EFYREVENQGYKLTFENISESYIDSVVNQGKLYLFQIYNKDFSAYSKGRP

NLHTLYWKALFDERNLQDVVYKLNGEAELFYRKQSIPKKITHPAKEAIAN

KNKDNPKKESVFEYDLIKDKRFTEDKFFFHCPITINFKSSGANKFNDEIN

LLLKEKANDVHILSIDRGERHLAYYTLVDGKGNIIKQDTFNIIGNDRMKT

NYHDKLAAIEKDRDSARKDWKKINNIKEMKEGYLSQVVHEIAKLVIEYNA

IVVFEDLNFGFKRGRFKVEKQVYQKLEKMLIEKLNYLVFKDNEFDKTGGV

LRAYQLTAPFETFKKMGKQTGIIYYVPAGFTSKICPVTGFVNQLYPKYES

VSKSQEFFSKFDKICYNLDKGYFEFSFDYKNFGDKAAKGKWTIASFGSRL

INFRNSDKNHNWDTREVYPTKELEKLLKDYSIEYGHGECIKAAICGESDK

KFFAKLTSVLNTILQMRNSKTGTELDYLISPVADVNGNFFDSRQAPKNMP

QDAAANGAYHIGLKGLMLLGRIKNNQEGKKLNLVIKNEEYFEFVQNRNN

Francisella novicida Cpf1 D917A/E1006A (SEQ ID NO: 380) (A917, A1006, and D1255 are bolded and underlined)

(SEQ ID NO: 380)

MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMEDEIAQNKDNLAQ

ISIKYQNQGKKDLLQASAEDDVKAIKDLLDQTNNLLHKLKIFHISQSEDK

ANILDKDEHFYLVFEECYFELANIVPLYNKIRNYITQKPYSDEKFKLNFE

NSTLANGWDKNKEPDNTAILFIKDDKYYLGVMNKKNNKIFDDKAIKENKG

EGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSID

EFYREVENQGYKLTFENISESYIDSVVNQGKLYLFQIYNKDFSAYSKGRP

NLHTLYWKALFDERNLQDVVYKLNGEAELFYRKQSIPKKITHPAKEAIAN

KNKDNPKKESVFEYDLIKDKRFTEDKFFFHCPITINFKSSGANKFNDEIN

LLLKEKANDVHILSIARGERHLAYYTLVDGKGNIIKQDTFNIIGNDRMKT

NYHDKLAAIEKDRDSARKDWKKINNIKEMKEGYLSQVVHEIAKLVIEYNA

IVVFADLNFGFKRGRFKVEKQVYQKLEKMLIEKLNYLVFKDNEFDKTGGV

LRAYQLTAPFETFKKMGKQTGIIYYVPAGFTSKICPVTGFVNQLYPKYES

VSKSQEFFSKFDKICYNLDKGYFEFSFDYKNFGDKAAKGKWTIASFGSRL

INFRNSDKNHNWDTREVYPTKELEKLLKDYSIEYGHGECIKAAICGESDK

KFFAKLTSVLNTILQMRNSKTGTELDYLISPVADVNGNFFDSRQAPKNMP

QDADANGAYHIGLKGLMLLGRIKNNQEGKKLNLVIKNEEYFEFVQNRNN

*Francisella novicida* Cpf1 D917A/D1255A (SEQ ID NO: 381) (A917, E1006, and A1255 are bolded and underlined)

(SEQ ID NO: 381)

MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMEDEIAQNKDNLAQ

ISIKYQNQGKKDLLQASAEDDVKAIKDLLDQTNNLLHKLKIFHISQSEDK

ANILDKDEHFYLVFEECYFELANIVPLYNKIRNYITQKPYSDEKFKLNFE

NSTLANGWDKNKEPDNTAILFIKDDKYYLGVMNKKNNKIFDDKAIKENKG

EGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSID

EFYREVENQGYKLTFENISESYIDSVVNQGKLYLFQIYNKDFSAYSKGRP

NLHTLYWKALFDERNLQDVVYKLNGEAELFYRKQSIPKKITHPAKEAIAN

KNKDNPKKESVFEYDLIKDKRFTEDKFFFHCPITINFKSSGANKFNDEIN

LLLKEKANDVHILSIARGERHLAYYTLVDGKGNIIKQDTFNIIGNDRMKT

NYHDKLAAIEKDRDSARKDWKKINNIKEMKEGYLSQVVHEIAKLVIEYNA

IVVFEDLNFGFKRGRFKVEKQVYQKLEKMLIEKLNYLVFKDNEFDKTGGV

LRAYQLTAPFETFKKMGKQTGIIYYVPAGFTSKICPVTGFVNQLYPKYES

VSKSQEFFSKFDKICYNLDKGYFEFSFDYKNFGDKAAKGKWTIASFGSRL

INFRNSDKNHNWDTREVYPTKELEKLLKDYSIEYGHGECIKAAICGESDK

KFFAKLTSVLNTILQMRNSKTGTELDYLISPVADVNGNFFDSRQAPKNMP

QDAAANGAYHIGLKGLMLLGRIKNNQEGKKLNLVIKNEEYFEFVQNRNN

*Francisella novicida* Cpf1 E1006A/D1255A (SEQ
ID NO: 382) (D917, A1006, and A1255 are bolded and
underlined)

(SEQ ID NO: 382)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGR

PNLHTLYWKALFDERNLQDVVYKLNGEAELFYRKQSIPKKITHPAKEAIA

NKNKDNPKKESVFEYDLIKDKRFTEDKFFFHCPITINFKSSGANKFNDEI

NLLLKEKANDVHILSIDRGERHLAYYTLVDGKGNIIKQDTFNIIGNDRMK

TNYHDKLAAIEKDRDSARKDWKKINNIKEMKEGYLSQVVHEIAKLVIEYN

AIVVFADLNFGFKRGRFKVEKQVYQKLEKMLIEKLNYLVFKDNEFDKTGG

VLRAYQLTAPFETFKKMGKQTGIIYYVPAGFTSKICPVTGFVNQLYPKYE

SVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESD

KKFFAKLTSVLNTILQMRNSKTGTELDYLISPVADVNGNFFDSRQAPKNM

PQDAAANGAYHIGLKGLMLLGRIKNNQEGKKLNLVIKNEEYFEFVQNRNN

*Francisella novicida* Cpf1 D917A/E1006A/D1255A (SEQ
ID NO: 383) (A917, A1006, and A1255 are bolded and
underlined)

(SEQ ID NO: 383)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMWDEIAQNKDNLAQ

ISIKYQNQGKKDLLQASAEDDVKAIKDLLDQTNNLLHKLKIFHISQSEDK

ANILDKDEHFYLVFEECYFELANIVPLYNKIRNYITQKPYSDEKFKLNFE

NSTLANGWDKNKEPDNTAILFIKDDKYYLGVMNKKNNKIFDDKAIKENKG

EGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSID

EFYREVENQGYKLTFENISESYIDSVVNQGKLYLFQIYNKDFSAYSKGRP

NLHTLYWKALFDERNLQDVVYKLNGEAELFYRKQSIPKKITHPAKEAIAN

KNKDNPKKESVFEYDLIKDKRFTEDKFFFHCPITINFKSSGANKFNDEIN

LLLKEKANDVHILSIARGERHLAYYTLVDGKGNIIKQDTFNIIGNDRMKT

NYHDKLAAIEKDRDSARKDWKKINNIKEMKEGYLSQVVHEIAKLVIEYNA

IVVFADLNFGFKRGRFKVEKQVYQKLEKMLIEKLNYLVFKDNEFDKTGGV

LRAYQLTAPFETFKKMGKQTGIIYYVPAGFTSKICPVTGFVNQLYPKYES

VSKSQEFFSKFDKICYNLDKGYFEFSFDYKNFGDKAAKGKWTIASFGSRL

INFRNSDKNHNWDTREVYPTKELEKLLKDYSIEYGHGECIKAAICGESDK

KFFAKLTSVLNTILQMRNSKTGTELDYLISPVADVNGNFFDSRQAPKNMP

QDAAANGAYHIGLKGLMLLGRIKNNQEGKKLNLVIKNEEYFEFVQNRNN

In some embodiments, the nucleic acid programmable DNA binding protein (napDNAbp) is a nucleic acid programmable DNA binding protein that does not require a canonical (NGG) PAM sequence. In some embodiments, the napDNAbp is an argonaute protein. One example of such a nucleic acid programmable DNA binding protein is an Argonaute protein from *Natronobacterium gregoryi* (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat Biotechnol.*, 2016 July; 34(7):768-73. PubMed PMID: 27136078; Swarts et al., *Nature.* 507 (7491) (2014): 258-61; and Swarts et al., *Nucleic Acids Res.* 43(10) (2015): 5120-9, each of which is incorporated herein by reference. The sequence of *Natronobacterium gregoryi* Argonaute is provided in SEQ ID NO: 416.

```
Wild type Natronobacterium gregoryi Argonaute
                                      (SEQ ID NO: 416)
                                      (SEQ ID NO: 416)
MTVIDLDSTTTADELTSGHTYDISVTLTGVYDNTDEQHPRMSLAFEQDNG

ERRYITLWKNTTPKDVFTYDYATGSTYIFTNIDYEVKDGYENLTATYQTT

VENATAQEVGTTDEDETFAGGEPLDHHLDDALNETPDDAETESDSGHVMT

SFASRDQLPEWTLHTYTLTATDGAKTDTEYARRTLAYTVRQELYTDHDAA

PVATDGLMLLTPEPLGETPLDLDCGVRVEADETRTLDYTTAKDRLLAREL

VEEGLKRSLWDDYLVRGIDEVLSKEPVLTCDEFDLHERYDLSVEVGHSGR

AYLHINFRHRFVPKLTLADIDDDNIYPGLRVKTTYRPRRGHIVWGLRDEC

ATDSLNTLGNQSVVAYHRNNQTPINTDLLDAIEAADRRVVETRRQGHGDD

AVSFPQELLAVEPNTHQIKQFASDGFHQQARSKTRLSASRCSEKAQAFAE

RLDPVRLNGSTVEFSSEFFTGNNEQQLRLLYENGESVLTFRDGARGAHPD

ETFSKGIVNPPESFEVAVVLPEQQADTCKAQWDTMADLLNQAGAPPTRSE

TVQYDAFSSPESISLNVAGAIDPSEVDAAFVVLPPDQEGFADLASPTETY

DELKKALANMGIYSQMAYFDRFRDAKIFYTRNVALGLLAAAGGVAFTTEH

AMPGDADMFIGIDVSRSYPEDGASGQINIAATATAVYKDGTILGHSSTRP

QLGEKLQSTDVRDIMKNAILGYQQVTGESPTHIVIHRDGFMNEDLDPATE

FLNEQGVEYDIVEIRKQPQTRLLAVSDVQYDTPVKSIAAINQNEPRATVA

TFGAPEYLATRDGGGLPRPIQIERVAGETDIETLTRQVYLLSQSHIQVHN

STARLPITTAYADQASTHATKGYLVQTGAFESNVGFL
```

In some embodiments, the napDNAbp is a prokaryotic homolog of an Argonaute protein. Prokaryotic homologs of Argonaute proteins are known and have been described, for example, in Makarova K., et al., "Prokaryotic homologs of Argonaute proteins are predicted to function as key components of a novel system of defense against mobile genetic elements", *Biol Direct.* 2009 Aug. 25; 4:29. doi: 10.1186/1745-6150-4-29, the entire contents of which is hereby incorporated by reference. In some embodiments, the napDNAbp is a *Marinitoga piezophila* Argunaute (MpAgo) protein. The CRISPR-associated *Marinitoga piezophila* Argunaute (MpAgo) protein cleaves single-stranded target sequences using 5'-phosphorylated guides. The 5' guides are used by all known Argonautes. The crystal structure of an MpAgo-RNA complex shows a guide strand binding site comprising residues that block 5' phosphate interactions. This data suggests the evolution of an Argonaute subclass with noncanonical specificity for a 5'-hydroxylated guide. See, e.g., Kaya et al., "A bacterial Argonaute with noncanonical guide RNA specificity", *Proc Natl Acad Sci USA.* 2016 Apr. 12; 113(15):4057-62, the entire contents of which are hereby incorporated by reference). It should be appreciated that other argonaute proteins may be used, and are within the scope of this disclosure.

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, C2c1, C2c2, and C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (C2c1, C2c2, and C2c3) have been described by Shmakov et al., "Discovery and Functional Characterization of Diverse Class 2 CRISPR Cas Systems", *Mol. Cell,* 2015 Nov. 5; 60(3): 385-397, the entire contents of which is hereby incorporated by reference. Effectors of two of the systems, C2c1 and C2c3, contain RuvC-like endonuclease domains related to Cpf1. A third system, C2c2 contains an effector with two predicated HEPN RNase domains. Production of mature CRISPR RNA is tracrRNA-independent, unlike production of CRISPR RNA by C2c1. C2c1 depends on both CRISPR RNA and tracrRNA for DNA cleavage. Bacterial C2c2 has been shown to possess a unique RNase activity for CRISPR RNA maturation distinct from its RNA-activated single-stranded RNA degradation activity. These RNase functions are different from each other and from the CRISPR RNA-processing behavior of Cpf1. See, e.g., East-Seletsky, et al., "Two distinct RNase activities of CRISPR-C2c2 enable guide-RNA processing and RNA detection", *Nature,* 2016 Oct. 13; 538(7624):270-273, the entire contents of which are hereby incorporated by reference. In vitro biochemical analysis of C2c2 in *Leptotrichia shahii* has shown that C2c2 is guided by a single CRISPR RNA and can be programmed to cleave ssRNA targets carrying complementary protospacers. Catalytic residues in the two conserved HEPN domains mediate cleavage. Mutations in the catalytic residues generate catalytically inactive RNA-binding proteins. See e.g., Abudayyeh et al., "C2c2 is a single-component programmable RNA-guided RNA-targeting CRISPR effector", *Science,* 2016 Aug. 5; 353 (6299), the entire contents of which are hereby incorporated by reference.

The crystal structure of *Alicyclobaccillus acidoterrastris* C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with C2c1-mediated cleavage resulting in a staggered seven-nucleotide break of target DNA. Structural comparisons between C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a C2c1, a C2c2, or a C2c3 protein. In some embodiments, the napDNAbp is a C2c1 protein. In some embodiments, the napDNAbp is a C2c2 protein. In some embodiments, the napDNAbp is a C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring C2c1, C2c2, or C2c3 protein. In some embodiments, the napDNAbp is a naturally-occurring C2c1, C2c2, or C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 438 or 439. In some embodiments, the napDNAbp comprises an amino acid sequence of any one SEQ ID NOs: 438 or 439. It should be appreciated that C2c1, C2c2, or C2c3 from other bacterial species may also be used in accordance with the present disclosure.

```
C2c1 (uniprot.org/uniprot/T0D7A2#)
sp|T0D7A2|C2C1_ALIAG CRISPR-associated endo-
nuclease C2c1 OS = Alicyclobacillus acido-
terrestris (strain ATCC 49025/DSM 3922/CIP 106132/
NCIMB 13137/GD3B) GN = c2c1 PE = 1 S V = 1
                                         (SEQ ID NO: 438)
MAVKSIKVKLRLDDMPEIRAGLWKLHKEVNAGVRYYTEWLSLLRQENLYR

RSPNGDGEQECDKTAEECKAELLERLRARQVENGHRGPAGSDDELLQLAR

QLYELLVPQAIGAKGDAQQIARKFLSPLADKDAVGGLGIAKAGNKPRWVR

MREAGEPGWEEEKEKAETRKSADRTADVLRALADFGLKPLMRVYTDSEMS

SVEWKPLRKGQAVRTWDRDMFQQAIERMMSWESWNQRVGQEYAKLVEQKN

RFEQKNFVGQEHLVHLVNQLQQDMKEASPGLESKEQTAHYVTGRALRGSD

KVFEKWGKLAPDAPFDLYDAEIKNVQRRNTRRFGSHDLFAKLAEPEYQAL

WREDASFLTRYAVYNSILRKLNHAKMFATFTLPDATAHPIWTRFDKLGGN

LHQYTFLFNEFGERRHAIRFHKLLKVENGVAREVDDVTVPISMSEQLDNL

LPRDPNEPIALYFRDYGAEQHFTGEFGGAKIQCRRDQLAHMHRRRGARDV

YLNVSVRVQSQSEARGERRPPYAAVFRLVGDNHRAFVHFDKLSDYLAEHP

DDGKLGSEGLLSGLRVMSVDLGLRTSASISVFRVARKDELKPNSKGRVPF

FFPIKGNDNLVAVHERSQLLKLPGETESKDLRAIREERQRTLRQLRTQLA

YLRLLVRCGSEDVGRRERSWAKLIEQPVDAANHMTPDWREAFENELQKLK

SLHGICSDKEWMDAVYESVRRVWRHMGKQVRDWRKDVRSGERPKIRGYAK

DVVGGNSIEQIEYLERQYKFLKSWSFFGKVSGQVIRAEKGSRFAITLREH

IDHAKEDRLKKLADRIIMEALGYVYALDERGKGKWVAKYPPCQLILLEEL

SEYQFNNDRPPSENNQLMQWSHRGVFQELINQAQVHDLLVGTMYAAFSSR

FDARTGAPGIRCRRVPARCTQEHNPEPFPWWLNKFVVEHTLDACPLRADD

LIPTGEGEIFVSPFSAEEGDFHQIHADLNAAQNLQQRLWSDFDISQIRLR

CDWGEVDGELVLIPRLTGKRTADSYSNKVFYTNTGVTYYERERGKKRRKV

FAQEKLSEEEAELLVEADEAREKSVVLMRDPSGIINRGNWTRQKEFWSMV

NQRIEGYLVKQIRSRVPLQDSACENTGDI

C2c2 (uniprot.org/uniprot/P0DOC6)
>sp|P0DOC6|C2C2_LEPSD CRISPR-associated endori-
bonuclease C2c2 OS = Leptotrichia shahii (strain
DSM 19757/CCUG 47503/CIP 107916/JCM 16776/LB37)
GN = c2c2 PE = 1 S V = 1
```

```
                                         (SEQ ID NO: 439)
MGNLFGHKRWYEVRDKKDFKIKRKVKVKRNYDGNKYILNINENNNKEKID

NNKFIRKYINYKKNDNILKEFTRKFHAGNILFKLKGKEGIIRIENNDDFL

ETEEVVLYIEAYGKSEKLKALGITKKKIIDEAIRQGITKDDKKIEIKRQE

NEEEIEIDIRDEYTNKTLNDCSIILRIIENDELETKKSIYEIFKNINMSL

YKIIEKIIENETEKVFENRYYEEHLREKLLKDDKIDVILTNFMEIREKIK

SNLEILGFVKFYLNVGGDKKKSKNKKMLVEKILNINVDLTVEDIADFVIK

ELEFWNITKRIEKVKKVNNEFLEKRRNRTYIKSYVLLDKHEKFKIERENK

KDKIVKFFVENIKNNSIKEKIEKILAEFKIDELIKKLEKELKKGNCDTEI

FGIPKKHYKVNFDSKKFSKKSDEEKELYKIIYRYLKGRIEKILVNEQKVR

LKKMEKIEIEKILNESILSEKILKRVKQYTLEHIMYLGKLRHNDIDMTTV

NTDDFSRLHAKEELDLELITFFASTNMELNKIFSRENINNDENIDFFGGD

REKNYVLDKKILNSKIKIIRDLDFIDNKNNITNNFIRKFTKIGTNERNRI

LHAISKERDLQGTQDDYNKVINIIQNLKISDEEVSKALNLDVVFKDKKNI

ITKINDIKISEENNNDIKYLPSFSKVLPEILNLYRNNPKNEPFDTIETEK

IVLNALIYVNKELYKKLILEDDLEENESKNIFLQELKKTLGNIDEIDENI

IENYYKNAQISASKGNNKAIKKYQKKVIECYIGYLRKNYEELFDFSDFKM

NIQEIKKQIKDINDNKTYERITVKTSDKTIVINDDFEYIISIFALLNSNA

VINKIRNRFFATSVWLNTSEYQNIIDILDEIMQLNTLRNECITENWNLNL

EEFIQKMKEIEKDFDDFKIQTKKEIFNNYYEDIKNNILTEFKDDINGCDV

LEKKLEKIVIFDDETKFEIDKKSNILQDEQRKLSNINKKDLKKKVDQYIK

DKDQEIKSKILCRIIFNSDFLKKYKKEIDNLIEDMESENENKFQEIYYPK

ERKNELYIYKKNLFLNIGNPNFDKIYGLISNDIKMADAKFLFNIDGKNIR

KNKISEIDAILKNLNDKLNGYSKEYKEKYIKKLKENDDFFAKNIQNKNYK

SFEKDYNRVSEYKKIRDLVEFNYLNKIESYLIDINWKLAIQMARFERDMH

YIVNGLRELGIIKLSGYNTGISRAYPKRNGSDGFYTTTAYYKFFDEESYK

KFEKICYGFGIDLSENSEINKPENESIRNYISHFYIVRNPFADYSIAEQI

DRVSNLLSYSTRYNNSTYASVFEVFKKDVNLDYDELKKKFKLIGNNDILE

RLMKPKKVSVLELESYNSDYIKNLIIELLTKIENTNDTL
```

Fusion Proteins Comprising a Nuclease Programmable DNA Binding Protein and an Adenosine Deaminase Some aspects of the disclosure provide fusion proteins comprising a nucleic acid programmable DNA binding protein (napDNAbp) and an adenosine deaminase. In some embodiments, any of the fusion proteins provided herein are base editors. In some embodiments, the napDNAbp is a Cas9 domain, a Cpf1 domain, a CasX domain, a CasY domain, a C2c1 domain, a C2c2 domain, aC2c3 domain, or an Argonaute domain. In some embodiments, the napDNAbp is any napDNAbp provided herein. Some aspects of the disclosure provide fusion proteins comprising a Cas9 domain and an adenosine deaminase. The Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the adenosine deaminases provided herein. In some embodiments, the fusion protein comprises the structure:
NH$_2$-[adenosine deaminase][napDNAbp]-COOH; or
NH$_2$-[napDNAbp]-[adenosine deaminase]-COOH In some embodiments, the fusion proteins comprising an adenosine deaminase and a napDNAbp (e.g., Cas9 domain) do not include a linker sequence. In some embodiments, a linker is present between the adenosine deaminase domain and the napDNAbp. In some embodiments, the "-" used in the general architecture above indicates the presence of an optional linker. In some embodiments, the adenosine deaminase and the napDNAbp are fused via any of the linkers provided herein. For example, in some embodiments the adenosine deaminase and the napDNAbp are fused via any of the linkers provided below in the section entitled "Linkers". In some embodiments, the adenosine deaminase and the napDNAbp are fused via a linker that comprises between 1 and 200 amino acids. In some embodiments, the adenosine deaminase and the napDNAbp are fused via a linker that comprises from 1 to 5, 1 to 10, 1 to 20, 1 to 30, 1 to 40, 1 to 50, 1 to 60, 1 to 80, 1 to 100, 1 to 150, 1 to 200, 5 to 10, 5 to 20, 5 to 30, 5 to 40, 5 to 60, 5 to 80, 5 to 100, 5 to 150, 5 to 200, 10 to 20, 10 to 30, 10 to 40, 10 to 50, 10 to 60, 10 to 80, 10 to 100, 10 to 150, 10 to 200, 20 to 30, 20 to 40, 20 to 50, 20 to 60, 20 to 80, 20 to 100, 20 to 150, 20 to 200, 30 to 40, 30 to 50, 30 to 60, 30 to 80, 30 to 100, 30 to 150, 30 to 200, 40 to 50, 40 to 60, 40 to 80, 40 to 100, 40 to 150, 40 to 200, 50 to 60 50 to 80, 50 to 100, 50 to 150, 50 to 200, 60 to 80, 60 to 100, 60 to 150, 60 to 200, 80 to 100, 80 to 150, 80 to 200, 100 to 150, 100 to 200, or 150 to 200 amino acids in length. In some embodiments, the adenosine deaminase and the napDNAbp are fused via a linker that comprises 4, 16, 32, or 104 amino acids in length. In some embodiments, the adenosine deaminase and the napDNAbp are fused via a linker that comprises the amino acid sequence of SGSETPGTSESATPES (SEQ ID NO: 10), SGGS (SEQ ID NO: 37), SGGSSGSETPGTSESATPESSGGS (SEQ ID NO: 384), SGGSSGGSSGSETPGTSESAT-PESSGGSSGGS (SEQ ID NO: 385), or GGSGGSPGSPAGSPTSTEEGTSESATPESGPGT-STEPSEGSAPGSPAGSPTSTEEGTSTE PSEGSAPGT-STEPSEGSAPGTSESATPESGPGSEPATSGGSGGS (SEQ ID NO: 386). In some embodiments, the adenosine deaminase and the napDNAbp are fused via a linker comprising the amino acid sequence SGSETPGTSESATPES (SEQ ID NO: 10), which may also be referred to as the XTEN linker. In some embodiments, the linker is 24 amino acids in length. In some embodiments, the linker comprises the amino acid sequence SGGSSGGSSGSETPGTSESATPES (SEQ ID NO: 685). In some embodiments, the linker is 40 amino acids in length. In some embodiments, the linker comprises the amino acid sequence SGGSSGGSSGSETPGTSESAT-PESSGGSSGGSSGGSSGGS (SEQ ID NO: 686). In some embodiments, the linker is 64 amino acids in length. In some embodiments, the linker comprises the amino acid sequence SGGSSGGSSGSETPGTSESAT-PESSGGSSGGSSGGSSGGSSGSETPGTSESAT-PESSGGS SGGS (SEQ ID NO: 687). In some embodiments, the linker is 92 amino acids in length. In some embodiments, the linker comprises the amino acid sequence (SEQ ID NO: 688)
PGSPAGSPTSTEEGTSESATPESGPGTSTEPSEGSAPGSPAGSPTSTEE

GTSTEPSEGSAPGTSTEPSEGSAPGTSESATPESGPGSEPATS.

Fusion Proteins Comprising an Inhibitor of Base Repair

Some aspects of the disclosure provide fusion proteins that comprise an inhibitor of base repair (IBR). For example a fusion protein comprising an adenosine deaminase and a nucleic acid programmable DNA binding protein may further comprise an inhibitor of base repair. In some embodiments, the IBR comprises an inhibitor of inosine base repair. In some embodiments, the IBR is an inhibitor of inosine base excision repair. In some embodiments, the inhibitor of inosine base excision repair is a catalytically inactive inosine specific nuclease (dISN).

In some embodiments, the fusion proteins provided herein further comprise a catalytically inactive inosine-specific nuclease (dISN). In some embodiments, any of the fusion proteins provided herein that comprise a napDNAbp (e.g., a nuclease active Cas9 domain, a nuclease inactive dCas9 domain, or a Cas9 nickase) and an adenosine deaminase may be further fused to a catalytically inactive inosine-specific nuclease (dISN) either directly or via a linker. Some aspects of this disclosure provide fusion proteins that comprise an adenosine deaminase (e.g., an engineered adenosine deaminase that deaminates adenosine in a DNA) a napDNAbp (e.g., a dCas9 or nCas9), and a dISN. Without wishing to be bound by any particular theory, cellular DNA-repair response to the presence of I:T heteroduplex DNA may be responsible for the decrease in nucleobase editing efficiency in cells. For example, AAG catalyzes removal of inosine (I) from DNA in cells, which may initiate base excision repair, with reversion of the I:T pair to a A:T pair as the most common outcome. In some embodiments, a catalytically inactive inosine-specific nuclease may be capable of binding an inosine in a nucleic acid, without cleaving the nucleic acid, to prevent removal (e.g., by cellular DNA repair mechanisms) of the inosine residue in the DNA.

In some embodiments, a dISN may inhibit (e.g., by steric hindrance) inosine removing enzymes from excising the inosine residue from DNA. For example, catalytically dead inosine glycosylases (e.g., alkyl adenine glycosylase [AAG]) will bind inosine but will not create an abasic site or remove the inosine, thereby sterically blocking the newly-formed inosine moiety from potential DNA damage/repair mechanisms. Thus, this disclosure contemplates a fusion protein comprising a napDNAbp and an adenosine deaminase further fused to a dISN. This disclosure contemplates a fusion protein comprising any Cas9 domain, for example, a Cas9 nickase (nCas9) domain, a catalytically inactive Cas9 (dCas9) domain, a high fidelity Cas9 domain, or a Cas9 domain with reduced PAM exclusivity. It should be understood that the use of a dISN may increase the editing efficiency of a adenosine deaminase that is capable of catalyzing a A to I change. For example, fusion proteins comprising a dISN domain may be more efficient in deaminating A residues. In some embodiments, the fusion protein comprises the structure:

$NH_2$-[adenosine deaminase]-[napDNAbp]-[dISN]-COOH;
$NH_2$-[adenosine deaminase]-[dISN]-[napDNAbp]-COOH;
$NH_2$-[dISN]-[adenosine deaminase]-[napDNAbp]-COOH;
$NH_2$-[napDNAbp]-[adenosine deaminase]-[dISN]-COOH;
$NH_2$-[napDNAbp]-[dISN]-[adenosine deaminase]-COOH; or
$NH_2$-[dISN]-[napDNAbp]-[adenosine deaminase]-COOH In some embodiments, the fusion proteins provided herein do not comprise a linker. In some embodiments, a linker is present between two domains or proteins (e.g., adenosine deaminase, napDNAbp, or dISN). In some embodiments, the "-" used in the general architecture above indicates the presence of an optional linker sequence. In some embodiments, a dISN comprises an inosine-specific nuclease that has reduced or nuclease activity, or does not have nuclease activity. In some embodiments, a dISN has up to 1%, up to 2%, up to 3%, up to 4%, up to 5%, up to 10%, up to 15%, up to 20%, up to 25%, up to 30%, up to 35%, up to 40%, up to 45%, or up to 50% of the nuclease activity of a corresponding (e.g., the wild-type) inosine-specific nuclease. In some embodiments, the dISN is a wild-type inosine-specific nuclease that comprises one or more mutations that reduces or eliminates the nuclease activity of the wild-type inosine-specific nuclease. Exemplary catalytically inactive inosine-specific nucleases include, without limitation, catalytically inactive AAG nuclease and catalytically inactive EndoV nuclease. In some embodiments, the catalytically inactive AAG nuclease comprises an E125Q mutation as compared to SEQ ID NO: 32, or a corresponding mutation in another AAG nuclease. In some embodiments, the catalytically inactive AAG nuclease comprises the amino acid sequence set forth in SEQ ID NO: 32. In some embodiments, the catalytically inactive EndoV nuclease comprises an D35A mutation as compared to SEQ ID NO 32, or a corresponding mutation in another EndoV nuclease. In some embodiments, the catalytically inactive EndoV nuclease comprises the amino acid sequence set forth in SEQ ID NO: 33. It should be appreciated that other catalytically inactive inosine-specific nucleases (dISNs) would be apparent to the skilled artisan and are within the scope of this disclosure.

In some embodiments, the dISN proteins provided herein include fragments of dISN proteins and proteins homologous to a dISN or a dISN fragment. For example, in some embodiments, a dISN comprises a fragment of the amino acid sequence set forth in SEQ ID NO: 32 or 33. In some embodiments, a dISN fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 32 or 33. In some embodiments, a dISN comprises an amino acid sequence homologous to the amino acid sequence set forth in SEQ ID NO: 32 or 33, or an amino acid sequence homologous to a fragment of the amino acid sequence set forth in SEQ ID NO: 32 or 33. In some embodiments, proteins comprising a dISN or fragments of a dISN or homologs of a dISN or a dISN fragment are referred to as "dISN variants." A dISN variant shares homology to a dISN, or a fragment thereof. For example a dISN variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild-type dISN or a dISN as set forth in SEQ ID NO: 32 or 33. In some embodiments, the dISN variant comprises a fragment of dISN, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type dISN or a dISN as set forth in SEQ ID NO: 32 or 33. In some embodiments, the dISN comprises the following amino acid sequence:

AAG nuclease (E125Q); mutated residue underlined in bold.
(SEQ ID NO: 32)
KGHLTRLGLEFFDQPAVPLARAFLGQVLVRRLPNGTELRGRIVETQAYLG

PEDEAAHSRGGRQTPRNRGMFMKPGTLYVYIIYGMYFCMNISSQGDGACV

LLRALEPLEGLETMRQLRSTLRKGTASRVLKDRELCSGPSKLCQALAINK

SFDQRDLAQDEAVWLERGPLEPSEPAVVAAARVGVGHAGEWARKPLRFYV

RGSPWVSVVDRVAEQDTQA

EndoV nuclease (D35A); mutated residue underlined in bold.
(SEQ ID NO: 33)
DLASLRAQQIELASSVIREDRLDKDPPDLIAGAAVGFEQGGEVTRAAMVL

LKYPSLELVEYKVARIATTMPYIPGFLSFREYPALLAAWEMLSQKPDLVF

VDGHGISHPRRLGVASHFGLLVDVPTIGVAKKRLCGKFEPLSSEPGALAP

LMDKGEQLAWVWRSKARCNPLFIATGHRVSVDSALAWVQRCMKGYRLPEP

TRWADAVASERPAFVRYTANQP

Suitable dISN proteins are provided herein and additional suitable dISN proteins are known to those in the art, and include, for example, AAG, EndoV, and variants thereof. It should be appreciated that additional proteins that block or inhibit base-excision repair, such as base excision of an inosine, are also within the scope of this disclosure. In some embodiments, a protein that binds inosine in DNA is used.

Some aspects of the disclosure relate to fusion proteins that comprise MBD4, or TDG, which may be used as inhibitors of base repair. Thus, this disclosure contemplates a fusion protein comprising a napDNAbp and an adenosine deaminase further fused to MBD4 or TDG. This disclosure contemplates a fusion protein comprising any Cas9 domain, for example, a Cas9 nickase (nCas9) domain, a catalytically inactive Cas9 (dCas9) domain, a high fidelity Cas9 domain, or a Cas9 domain with reduced PAM exclusivity. It should be understood that the use of MBD4 or TDG may increase the editing efficiency of a adenosine deaminase that is capable of catalyzing a A to I change. For example, fusion proteins comprising MBD4 or TDG may be more efficient in deaminating A residues. In some embodiments, the fusion protein comprises the structure:

NH$_2$-[adenosine deaminase]-[napDNAbp]-[MBD4 or TDG]-COOH;

NH$_2$-[adenosine deaminase]-[MBD4 or TDG]-[napDNAbp]-COOH;

NH$_2$-[MBD4 or TDG]-[adenosine deaminase]-[napDNAbp]-COOH;

NH$_2$-[napDNAbp]-[adenosine deaminase]-[MBD4 or TDG]-COOH;

NH$_2$-[napDNAbp]-[MBD4 or TDG]-[adenosine deaminase]-COOH; or

NH$_2$-[MBD4 or TDG]-[napDNAbp]-[adenosine deaminase]-COOH

In some embodiments, the fusion proteins provided herein do not comprise a linker. In some embodiments, a linker is present between two domains or proteins (e.g., adenosine deaminase, napDNAbp, MBD4 or TDG). In some embodiments, the "-" used in the general architecture above indicates the presence of an optional linker sequence. In some embodiments, the MBD4 or TDG is a wild-type MBD4 or TDG. Exemplary, MBD4 and TDG amino acid sequences would be apparent to the skilled artisan and include, without limitation, the MBD4 and TDG amino acid sequences provided below.

Sequence of MBD4:
(SEQ ID NO: 689)
GTTGLESLSLGDRGAAPTVTSSERLVPDPPNDLRKEDVAMELERVGEDEE

QMMIKRSSECNPLLQEPIASAQFGATAGTECRKSVPCGWERVVKQRLFGK

-continued
TAGRFDVYFISPQGLKFRSKSSLANYLHKNGETSLKPEDFDFTVLSKRGI

KSRYKDCSMAALTSHLQNQSNNSNWNLRTRSKCKKDVFMPPSSSSELQES

RGLSNFTSTHLLLKEDEGVDDVNFRKVRKPKGKVTILKGIPIKKTKKGCR

KSCSGFVQSDSKRESVCNKADAESEPVAQKSQLDRTVCISDAGACGETLS

VTSEENSLVKKKERSLSSGSNFCSEQKTSGIINKFCSAKDSEHNEKYEDT

FLESEEIGTKVEVVERKEHLHTDILKRGSEMDNNCSPTRKDFTGEKIFQE

DTIPRTQIERRKTSLYFSSKYNKEALSPPRRKAFKKWTPPRSPFNLVQET

LFHDPWKLLIATIFLNRTSGKMAIPVLWKFLEKYPSAEVARTADWRDVSE

LLKPLGLYDLRAKTIVKFSDEYLTKQWKYPIELHGIGKYGNDSYRIFCVN

EWKQVHPEDHKLNKYHDWLWENHEKLSLS

Sequence of TDG:
(SEQ ID NO: 690)
EAENAGSYSLQQAQAFYTFPFQQLMAEAPNMAVVNEQQMPEEVPAPAPAQ

EPVQEAPKGRKRKPRTTEPKQPVEPKKPVESKKSGKSAKSKEKQEKITDT

FKVKRKVDRFNGVSEAELLTKTLPDILTFNLDIVIIGINPGLMAAYKGHH

YPGPGNHFWKCLFMSGLSEVQLNHMDDHTLPGKYGIGFTNMVERTTPGSK

DLSSKEFREGGRILVQKLQKYQPRIAVFNGKCIYEIFSKEVFGVKVKNLE

FGLQPHKIPDTETLCYVMPSSSARCAQFPRAQDKVHYYIKLKDLRDQLKG

IERNMDVQEVQYTFDLQLAQEDAKKMAVKEEKYDPGYEAAYGGAYGENPC

SSEPCGFSSNGLIESVELRGESAFSGIPNGQWMTQSFTDQIPSFSNHCGT

QEQEEESHA

In some embodiments, the MBD4 or TDG proteins provided herein include fragments of MBD4 or TDG proteins and proteins homologous to a MBD4 or a TDG fragment. For example, in some embodiments, a MBD4 or TDG protein comprises a fragment of the amino acid sequence set forth in SEQ ID NO: 689 or 690. In some embodiments, a MBD4 or TDG fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 689 or 690. In some embodiments, a MBD4 or TDG protein comprises an amino acid sequence homologous to the amino acid sequence set forth in SEQ ID NO: 689 or 690, or an amino acid sequence homologous to a fragment of the amino acid sequence set forth in SEQ ID NO: 689 or 690. In some embodiments, proteins comprising a MBD4 or TDG or fragments of a MBD4 or TDG or homologs of a MBD4 or TDG fragment are referred to as "MBD4 varients" or "TDG variants." A MBD4 or TDG variant shares homology to a MBD4 or TDG, or a fragment thereof. For example a MBD4 or TDG variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild-type MBD4 or TDG or a MBD4 or TDG as set forth in SEQ ID NO: 689 or 690. In some embodiments, the MBD4 or TDG variant comprises a fragment of MBD4 or TDG, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type MBD4 or TDG or a MBD4 or TDG as set forth in SEQ ID NO: 689 or 690. In some embodiments, the dISN comprises the following amino acid sequence:

Some aspects of the disclosure relate to fusion proteins that comprise a uracil glycosylase inhibitor (UGI) domain. In some embodiments, any of the fusion proteins provided herein that comprise a napDNAbp (e.g., a nuclease active Cas9 domain, a nuclease inactive dCas9 domain, or a Cas9 nickase), and an adenosine deaminase, may be further fused to a UGI domain either directly or via a linker. Some aspects of this disclosure provide fusion proteins that comprise an adenosine deaminase (e.g., an engineered adenosine deaminase that deaminates deoxyadenosine in a DNA) a napDNAbp (e.g., a dCas9 or nCas9), and a UGI domain. Without wishing to be bound by any particular theory, the cellular DNA-repair response to the presence of I:T heteroduplex DNA may be responsible for the decrease in nucleobase editing efficiency in cells. For example, alkyl adenosine glycosylase (AAG) is involved in inosine (I) associated DNA repair and catalyzes removal of I from DNA in cells. This may initiate base excision repair, with reversion of the I:T pair to a A:T pair as the most common outcome. A UGI domain, may inhibit (e.g., by steric hindrance) inosine removing enzymes from excising the inosine residue from DNA. Thus, this disclosure contemplates a fusion protein comprising a Cas9 domain and an adenosine deaminase domain further fused to a UGI domain. This disclosure contemplates a fusion protein comprising any nucleic acid programmable DNA binding protein, for example, a Cas9 nickase (nCas9) domain, a catalytically inactive Cas9 (dCas9) domain, a high fidelity Cas9 domain, or a Cas9 domain with reduced PAM exclusivity. It should be understood that the use of a UGI domain may increase the editing efficiency of a adenosine deaminase that is capable of catalyzing a A to I change. For example, fusion proteins comprising a UGI domain may be more efficient in deaminating adenosine residues. In some embodiments, the fusion protein comprises the structure:
NH$_2$-[adenosine deaminase]-[napDNAbp]-[UGI]-COOH;
NH$_2$-[adenosine deaminase][UGI]-[napDNAbp]-COOH;
NH$_2$-[UGI]-[adenosine deaminase]-[napDNAbp]-COOH;
NH$_2$-[napDNAbp]-[adenosine deaminase]-[UGI]-COOH;
NH$_2$-[napDNAbp]-[UGI]-[adenosine deaminase]-COOH; or
NH$_2$-[UGI]-[napDNAbp]-[adenosine deaminase]-COOH In some embodiments, the fusion proteins provided herein do not comprise a linker. In some embodiments, a linker is present between any of the domains or proteins (e.g., adenosine deaminase, napDNAbp, and/or UGI domains). In some embodiments, the "-" used in the general architecture above indicates the presence of an optional linker.

In some embodiments, a UGI domain comprises a wild-type UGI or a UGI as set forth in SEQ ID NO: 3. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 3. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 3. In some embodiments, a UGI comprises an amino acid sequence homologous to the amino acid sequence set forth in SEQ ID NO: 3 or an amino acid sequence homologous to a fragment of the amino acid sequence set forth in SEQ ID NO: 3. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 3. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 3. In some embodiments, the UGI comprises the following amino acid sequence:

```
sp|P14739|UNGI_BPPB2 Uracil-DNA glycosylase in-
hibitor
                                      (SEQ ID NO: 3)
MTNLSDIIEKETGKQLVIQESILMLPEEVEEVIGNKPESDILVHTAYDES

TDENVMLLTSDAPEYKPWALVIQDSNGENKIKML
```

Suitable UGI protein and nucleotide sequences are provided herein and additional suitable UGI sequences are known to those in the art, and include, for example, those published in Wang et al., Uracil-DNA glycosylase inhibitor gene of bacteriophage PBS2 encodes a binding protein specific for uracil-DNA glycosylase. *J. Biol. Chem.* 264: 1163-1171 (1989); Lundquist et al., Site-directed mutagenesis and characterization of uracil-DNA glycosylase inhibitor protein. Role of specific carboxylic amino acids in complex formation with *Escherichia coli* uracil-DNA glycosylase. *J. Biol. Chem.* 272:21408-21419 (1997); Ravishankar et al., X-ray analysis of a complex of *Escherichia coli* uracil DNA glycosylase (EcUDG) with a proteinaceous inhibitor. The structure elucidation of a prokaryotic UDG. *Nucleic Acids Res.* 26:4880-4887 (1998); and Putnam et al., Protein mimicry of DNA from crystal structures of the uracil-DNA glycosylase inhibitor protein and its complex with *Escherichia coli* uracil-DNA glycosylase. *J. Mol. Biol.* 287:331-346 (1999), the entire contents of each are incorporated herein by reference.

It should be appreciated that additional proteins that block or inhibit base-excision repair, such as base excision of an inosine, are also within the scope of this disclosure. In some embodiments, a protein that binds DNA is used. In another embodiment, a substitute for UGI is used. In some embodiments, a uracil glycosylase inhibitor is a protein that binds single-stranded DNA. For example, a uracil glycosylase inhibitor may be a *Erwinia tasmaniensis* single-stranded binding protein. In some embodiments, the single-stranded binding protein comprises the amino acid sequence (SEQ ID NO: 29). In some embodiments, a uracil glycosylase inhibitor is a protein that binds uracil. In some embodiments, a uracil glycosylase inhibitor is a protein that binds uracil in DNA. In some embodiments, a uracil glycosylase inhibitor is a catalytically inactive uracil DNA-glycosylase protein. In some embodiments, a uracil glycosylase inhibitor is a catalytically inactive uracil DNA-glycosylase protein that does not excise uracil from the DNA. For example, a uracil glycosylase inhibitor is a UdgX. In some embodiments, the UdgX comprises the amino acid sequence (SEQ ID NO: 30). As another example, a uracil glycosylase inhibitor is a catalytically inactive UDG. In some embodiments, a catalytically inactive UDG comprises the amino acid sequence (SEQ ID NO: 31). It should be appreciated that other uracil glycosylase inhibitors would be apparent to the skilled artisan and are within the scope of this disclosure. In some embodiments, a uracil glycosylase inhibitor is a protein that is homologous to any one of SEQ ID NOs: 29-31. In some embodiments, a uracil glycosylase inhibitor is a protein that is at least 50% identical, at least 55% identical, at least 60% identical, at least 65% identical, at least 70% identical, at least 75% identical, at least 80% identical at least 85% identical, at least 90% identical, at least 95% identical, at least 96% identical, at least 98% identical, at least 99% identical, or at least 99.5% identical to any one of SEQ ID NOs: 29-31.

```
Erwinia tasmaniensis SSB (themostable single-
stranded DNA binding protein)
                                      (SEQ ID NO: 29)
MASRGVNKVILVGNLGQDPEVRYMPNGGAVANITLATSESWRDKQTGETK

EKTEWHRVVLFGKLAEVAGEYLRKGSQVYIEGALQTRKWTDQAGVEKYTT

EVVVNVGGTMQMLGGRSQGGGASAGGQNGGSNNGWGQPQQPQGGNQFSGG

AQQQARPQQQPQQNNAPANNEPPIDFDDDIP

UdgX (binds to Uracil in DNA but does not excise)
                                      (SEQ ID NO: 30)
MAGAQDFVPHTADLAELAAAAGECRGCGLYRDATQAVFGAGGRSARIMMI

GEQPGDKEDLAGLPFVGPAGRLLDRALEAADIDRDALYVTNAVKHFKFTR

AAGGKRRIHKTPSRTEVVACRPWLIAEMTSVEPDVVVLLGATAAKALLGN

DFRVTQHRGEVLHVDDVPGDPALVATVHPSSLLRGPKEERESAFAGLVDD

LRVAADVRP

UDG (catalytically inactive human UDG, binds to
Uracil in DNA but does not excise)
                                      (SEQ ID NO: 31)
MIGQKTLYSFFSPSPARKRHAPSPEPAVQGTGVAGVPEESGDAAAIPAKK

APAGQEEPGTPPSSPLSAEQLDRIQRNKAAALLRLAARNVPVGFGESWKK

HLSGEFGKPYFIKLMGFVAEERKHYTVYPPPHQVFTWTQMCDIKDVKVVI

LGQEPYHGPNQAHGLCFSVQRPVPPPPSLENIYKELSTDIEDFVHPGHGD

LSGWAKQGVLLLNAVLTVRAHQANSHKERGWEQFTDAVVSWLNQNSNGLV

FLLWGSYAQKKGSAIDRKRHHVLQTAHPSPLSVYRGFFGCRHFSKTNELL

QKSGKKPIDWKEL
```

Fusion Proteins Comprising a Nuclear Localization Sequence (NLS)

In some embodiments, the fusion proteins provided herein further comprise one or more nuclear targeting sequences, for example, a nuclear localization sequence (NLS). In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the IBR (e.g., dISN). In some embodiments, the NLS is fused to the C-terminus of the IBR (e.g., dISN). In some embodiments, the NLS is fused to the N-terminus of the napDNAbp. In some embodiments, the NLS is fused to the C-terminus of the napDNAbp. In some embodiments, the NLS is fused to the N-terminus of the adenosine deaminase. In some embodiments, the NLS is fused to the C-terminus of the adenosine deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, the NLS comprises an amino acid sequence as set forth in SEQ ID NO: 4 or SEQ ID NO: 5. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, a NLS comprises the amino acid sequence PKKKRKV (SEQ ID NO: 4) or MDSLLMNRRKFLY-QFKNVRWAKGRRETYLC (SEQ ID NO: 5).

In some embodiments, the general architecture of exemplary fusion proteins with an adenosine deaminase and a napDNAbp comprises any one of the following structures, where NLS is a nuclear localization sequence (e.g., any NLS provided herein), $NH_2$ is the N-terminus of the fusion protein, and COOH is the C-terminus of the fusion protein.

Fusion proteins comprising an adenosine deaminase, a napDNAbp, and a NLS.
$NH_2$-[NLS]-[adenosine deaminase]-[napDNAbp]-COOH;
$NH_2$-[adenosine deaminase]-[NLS]-[napDNAbp]-COOH;
$NH_2$-[adenosine deaminase]-[napDNAbp]-[NLS]-COOH;
$NH_2$-[NLS]-[napDNAbp]-[adenosine deaminase]-COOH;
$NH_2$-[napDNAbp]-[NLS]-[adenosine deaminase]-COOH;
$NH_2$-[napDNAbp]-[adenosine deaminase]-[NLS]-COOH;

In some embodiments, the fusion proteins provided herein do not comprise a linker. In some embodiments, a linker is present between one or more of the domains or proteins (e.g., adenosine deaminase, napDNAbp, and/or NLS). In some embodiments, the "-" used in the general architecture above indicates the presence of an optional linker.

Fusion proteins comprising an adenosine deaminase, a napDNAbp, and an inhibitor of base repair (IBR).
$NH_2$-[IBR]-[adenosine deaminase]-[napDNAbp]-COOH;
$NH_2$-[adenosine deaminase]-[IBR]-[napDNAbp]-COOH;
$NH_2$-[adenosine deaminase]-[napDNAbp]-[IBR]-COOH;
$NH_2$-[IBR]-[napDNAbp]-[adenosine deaminase]-COOH;
$NH_2$-[napDNAbp]-[IBR]-[adenosine deaminase]-COOH;
$NH_2$-[napDNAbp]-[adenosine deaminase]-[IBR]-COOH;

In some embodiments, the fusion proteins provided herein do not comprise a linker. In some embodiments, a linker is present between one or more of the domains or proteins (e.g., adenosine deaminase, napDNAbp, and/or IBR). In some embodiments, the "-" used in the general architecture above indicates the presence of an optional linker.

Fusion proteins comprising an adenosine deaminase, a napDNAbp, an inhibitor of base repair (IBR) and a NLS.
$NH_2$-[IBR]-[NLS]-[adenosine deaminase]-[napDNAbp]-COOH;
$NH_2$-[NLS]-[IBR]-[adenosine deaminase]-[napDNAbp]-COOH;
$NH_2$-[NLS]-[adenosine deaminase]-[IBR]-[napDNAbp]-COOH;
$NH_2$-[NLS]-[adenosine deaminase]-[napDNAbp]-[IBR]-COOH;
$NH_2$-[IBR]-[adenosine deaminase]-[NLS]-[napDNAbp]-COOH;
$NH_2$-[adenosine deaminase]-[IBR]-[NLS]-[napDNAbp]-COOH;
$NH_2$-[adenosine deaminase]-[NLS]-[IBR]-[napDNAbp]-COOH;
$NH_2$-[adenosine deaminase]-[NLS]-[napDNAbp]-[IBR]-COOH;
$NH_2$-[IBR]-[adenosine deaminase]-[napDNAbp]-[NLS]-COOH;
$NH_2$-[adenosine deaminase]-[IBR]-[napDNAbp]-[NLS]-COOH;
$NH_2$-[adenosine deaminase][napDNAbp]-[IBR]-[NLS]-COOH;
$NH_2$-[adenosine deaminase]-[napDNAbp]-[NLS]-[IBR]-COOH;
$NH_2$-[IBR]-[NLS]-[napDNAbp]-[adenosine deaminase]-COOH;
$NH_2$-[NLS]-[IBR]-[napDNAbp]-[adenosine deaminase]-COOH;
$NH_2$-[NLS]-[napDNAbp]-[IBR]-[adenosine deaminase]-COOH;
$NH_2$-[NLS]-[napDNAbp]-[adenosine deaminase]-[IBR]-COOH;
$NH_2$[IBR]-[napDNAbp]-[NLS]-[adenosine deaminase]-COOH;
$NH_2$-[napDNAbp]-[IBR]-[NLS]-[adenosine deaminase]-COOH;
$NH_2$-[napDNAbp]-[NLS]-[IBR]-[adenosine deaminase]-COOH;
$NH_2$-[napDNAbp]-[NLS]-[adenosine deaminase]-[IBR]-COOH;
$NH_2$-[IBR]-[napDNAbp]-[adenosine deaminase]-[NLS]-COOH;
$NH_2$-[napDNAbp]-[IBR]-[adenosine deaminase]-[NLS]-COOH;
$NH_2$-[napDNAbp]-[adenosine deaminase]-[IBR]-[NLS]-COOH;
$NH_2$-[napDNAbp]-[adenosine deaminase]-[NLS]-[IBR]-COOH;

In some embodiments, the fusion proteins provided herein do not comprise a linker. In some embodiments, a linker is present between one or more of the domains or proteins (e.g., adenosine deaminase, napDNAbp, NLS, and/or IBR). In some embodiments, the "-" used in the general architecture above indicates the presence of an optional linker.

Some aspects of the disclosure provide fusion proteins that comprise a nucleic acid programmable DNA binding protein (napDNAbp) and at least two adenosine deaminase domains. Without wishing to be bound by any particular theory, dimerization of adenosine deaminases (e.g., in cis or in trans) may improve the ability (e.g., efficiency) of the fusion protein to modify a nucleic acid base, for example to deaminate adenine. In some embodiments, any of the fusion proteins may comprise 2, 3, 4 or 5 adenosine deaminase domains. In some embodiments, any of the fusion proteins provided herein comprise two adenosine deaminases. In some embodiments, any of the fusion proteins provided herein contain only two adenosine deaminases. In some embodiments, the adenosine deaminases are the same. In some embodiments, the adenosine deaminases are any of the adenosine deaminases provided herein. In some embodiments, the adenosine deaminases are different. In some embodiments, the first adenosine deaminase is any of the adenosine deaminases provided herein, and the second adenosine is any of the adenosine deaminases provided herein, but is not identical to the first adenosine deaminase. As one example, the fusion protein may comprise a first adenosine deaminase and a second adenosine deaminase that both comprise the amino acid sequence of SEQ ID NO: 72, which contains a A106V, D108N, D147Y, and E155V mutation from ecTadA (SEQ ID NO: 1). As another example, the fusion protein may comprise a first adenosine deaminase domain that comprises the amino amino acid sequence of SEQ ID NO: 72, which contains a A106V, D108N, D147Y, and E155V mutation from ecTadA (SEQ ID NO: 1), and a second adenosine deaminase that comprises the amino acid sequence of SEQ ID NO: 421, which contains a L84F, A106V, D108N, H123Y, D147Y, E155V, and I156F mutation from ecTadA (SEQ ID NO: 1).

In some embodiments, the fusion protein comprises two adenosine deaminases (e.g., a first adenosine deaminase and a second adenosine deaminase). In some embodiments, the fusion protein comprises a first adenosine deaminase and a second adenosine deaminase. In some embodiments, the first adenosine deaminase is N-terminal to the second adenosine deaminase in the fusion protein. In some embodiments, the first adenosine deaminase is C-terminal to the second adenosine deaminase in the fusion protein. In some embodiments, the first adenosine deaminase and the second deaminase are fused directly or via a linker. In some embodiments, the linker is any of the linkers provided herein, for example, any of the linkers described in the "Linkers" section. In some embodiments, the linker comprises the amino acid sequence of any one of SEQ ID NOs: 10, 37-40, 384-386, or 685-688. In some embodiments, the first adenosine deaminase is the same as the second adenosine deaminase. In some embodiments, the first adenosine deaminase and the second adenosine deaminase are any of the adenosine deaminases described herein. In some embodiments, the first adenosine deaminase and the second adenosine deaminase are different. In some embodiments, the first adenosine deaminase is any of the adenosine deaminases provided herein. In some embodiments, the second adenosine deaminase is any of the adenosine deaminases provided herein but is not identical to the first adenosine deaminase. In some embodiments, the first adenosine deaminase is an ecTadA adenosine deaminase. In some embodiments, the first adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1, 64-84, 420-437, 672-684, or to any of the adenosine deaminases provided herein. In some embodiments, the first adenosine deaminase comprises the amino acid sequence of SEQ ID NO: 1. In some embodiments, the second adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1, 64-84, 420-437, 672-684, or to any of the adenosine deaminases provided herein. In some embodiments, the second adenosine deaminase comprises the amino acid sequence of SEQ ID NO: 1. In some embodiments, the first adenosine deaminase and the second adenosine deaminase of the fusion protein comprise the mutations in ecTadA (SEQ ID NO: 1), or corresponding mutations in another adenosine deaminase, as shown in any one of the constructs provided in Table 4 (e.g., pNMG-371, pNMG-477, pNMG-576, pNMG-586, and pNMG-616). In some embodiments, the fusion protein comprises the two adenosine deaminases (e.g., a first adenosine deaminase and a second adenosine deaminase) of any one of the constructs (e.g., pNMG-371, pNMG-477, pNMG-576, pNMG-586, and pNMG-616) in Table 4.

In some embodiments, the general architecture of exemplary fusion proteins with a first adenosine deaminase, a second adenosine deaminase, and a napDNAbp comprises any one of the following structures, where NLS is a nuclear localization sequence (e.g., any NLS provided herein), $NH_2$ is the N-terminus of the fusion protein, and COOH is the C-terminus of the fusion protein.

Fusion proteins comprising a first adenosine deaminase, a second adenosine deaminase, and a napDNAbp.
$NH_2$-[first adenosine deaminase]-[second adenosine deaminase]-[napDNAbp]-COOH;
$NH_2$-[first adenosine deaminase]-[napDNAbp]-[second adenosine deaminase]-COOH;
$NH_2$-[napDNAbp]-[first adenosine deaminase]-[second adenosine deaminase]-COOH;
$NH_2$-[second adenosine deaminase]-[first adenosine deaminase]-[napDNAbp]-COOH;
$NH_2$-[second adenosine deaminase]-[napDNAbp]-[first adenosine deaminase]-COOH;
$NH_2$-[napDNAbp]-[second adenosine deaminase]-[first adenosine deaminase]-COOH;

In some embodiments, the fusion proteins provided herein do not comprise a linker. In some embodiments, a linker is present between one or more of the domains or proteins (e.g., first adenosine deaminase, second adenosine deaminase, and/or napDNAbp). In some embodiments, the "-" used in the general architecture above indicates the presence of an optional linker.

Fusion proteins comprising a first adenosine deaminase, a second adenosine deaminase, a napDNAbp, and an NLS.
$NH_2$-[NLS]-[first adenosine deaminase]-[second adenosine deaminase]-[napDNAbp]-COOH;
$NH_2$-[first adenosine deaminase]-[NLS]-[second adenosine deaminase]-[napDNAbp]-COOH;
$NH_2$-[first adenosine deaminase]-[second adenosine deaminase]-[NLS]-[napDNAbp]-COOH;
$NH_2$-[first adenosine deaminase]-[second adenosine deaminase]-[napDNAbp]-[NLS]-COOH;
$NH_2$-[NLS]-[first adenosine deaminase]-[napDNAbp]-[second adenosine deaminase]-COOH;
$NH_2$-[first adenosine deaminase]-[NLS]-[napDNAbp]-[second adenosine deaminase]-COOH;
$NH_2$-[first adenosine deaminase]-[napDNAbp]-[NLS]-[second adenosine deaminase]-COOH;
$NH_2$-[first adenosine deaminase]-[napDNAbp]-[second adenosine deaminase]-[NLS]-COOH;
$NH_2$-[NLS]-[napDNAbp]-[first adenosine deaminase]-[second adenosine deaminase]-COOH;
$NH_2$-[napDNAbp]-[NLS]-[first adenosine deaminase]-[second adenosine deaminase]-COOH;
$NH_2$-[napDNAbp]-[first adenosine deaminase]-[NLS]-[second adenosine deaminase]-COOH;
$NH_2$-[napDNAbp]-[first adenosine deaminase]-[second adenosine deaminase]-[NLS]-COOH;
$NH_2$-[NLS]-[second adenosine deaminase]-[first adenosine deaminase]-[napDNAbp]-COOH;
$NH_2$-[second adenosine deaminase]-[NLS]-[first adenosine deaminase]-[napDNAbp]-COOH;
$NH_2$-[second adenosine deaminase]-[first adenosine deaminase]-[NLS]-[napDNAbp]-COOH;
$NH_2$-[second adenosine deaminase]-[first adenosine deaminase]-[napDNAbp]-[NLS]-COOH;
$NH_2$-[NLS]-[second adenosine deaminase]-[napDNAbp]-[first adenosine deaminase]-COOH;

NH₂-[second adenosine deaminase]-[NLS]-[napDNAbp]-[first adenosine deaminase]-COOH;
NH₂-[second adenosine deaminase]-[napDNAbp]-[NLS]-[first adenosine deaminase]-COOH;
NH₂-[second adenosine deaminase]-[napDNAbp]-[first adenosine deaminase]-[NLS]-COOH;
NH₂-[NLS]-[napDNAbp]-[second adenosine deaminase]-[first adenosine deaminase]-COOH;
NH₂-[napDNAbp]-[NLS]-[second adenosine deaminase]-[first adenosine deaminase]-COOH;
NH₂-[napDNAbp]-[second adenosine deaminase]-[NLS]-[first adenosine deaminase]-COOH;
NH₂-[napDNAbp]-[second adenosine deaminase]-[first adenosine deaminase]-[NLS]-COOH;

In some embodiments, the fusion proteins provided herein do not comprise a linker. In some embodiments, a linker is present between one or more of the domains or proteins (e.g., first adenosine deaminase, second adenosine deaminase, napDNAbp, and/or NLS). In some embodiments, the "-" used in the general architecture above indicates the presence of an optional linker.

It should be appreciated that the fusion proteins of the present disclosure may comprise one or more additional features. For example, in some embodiments, the fusion protein may comprise cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Linkers

In certain embodiments, linkers may be used to link any of the protein or protein domains described herein. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-110, 110-120, 120-130, 130-140, 140-150, or 150-200 amino acids in length. Longer or shorter linkers are also contemplated. In some embodiments, a linker comprises the amino acid sequence SGSETPGTSESATPES (SEQ ID NO: 10), which may also be referred to as the XTEN linker. In some embodiments, a linker comprises the amino acid sequence SGGS (SEQ ID NO: 37). In some embodiments, a linker comprises (SGGS)$_n$ (SEQ ID NO: 37), (GGGS)n (SEQ ID NO: 38), (GGGGS)n (SEQ ID NO: 39), (G)n, (EAAAK)n (SEQ ID NO: 40), (GGS)n, SGSETPGTSESATPES (SEQ ID NO: 10), or (XP)$_n$ motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15. In some embodiments, a linker comprises SGSETPGTSESATPES (SEQ ID NO: 10), and SGGS (SEQ ID NO: 37). In some embodiments, a linker comprises SGGSSGSETPGTSESATPESSGGS (SEQ ID NO: 384). In some embodiments, a linker comprises SGGSSGGSSGSETPGTSESATPESSGGSSGGS (SEQ ID NO: 385). In some embodiments, a linker comprises GGSGGSPGSPAGSPTSTEEGTSESATPESGPGTSTEPSEGSAPGSPAGSPTSTEEGTSTE PSEGSAPGTSTEPSEGSAPGTSESATPESGPGSEPATSGGSGGS (SEQ ID NO: 386). In some embodiments, the linker is 24 amino acids in length. In some embodiments, the linker comprises the amino acid sequence SGGSSGGSSGSETPGTSESATPES (SEQ ID NO: 685). In some embodiments, the linker is 40 amino acids in length. In some embodiments, the linker comprises the amino acid sequence SGGSSGGSSGSETPGTSESATPESSGGSSGGSSGGSSGGS (SEQ ID NO: 686). In some embodiments, the linker is 64 amino acids in length. In some embodiments, the linker comprises the amino acid sequence SGGSSGGSSGSETPGTSESATPESSGGSSGGSSGGSSGGSSGSETPGTSESATPESSGGS SGGS (SEQ ID NO: 687). In some embodiments, the linker is 92 amino acids in length. In some embodiments, the linker comprises the amino acid sequence PGSPAGSPTSTEEGTSESATPESGPGTSTEPSEGSAPGSPAGSPTSTEEGTSTEPSEGSAP GTSTEPSEGSAPGTSESATPESGPGSEPATS (SEQ ID NO: 688). It should be appreciated that any of the linkers provided herein may be used to link a first adenosine deaminase and a second adenosine deaminase; an adenosine deaminase (e.g., a first or a second adenosine deaminase) and a napDNAbp; a napDNAbp and an NLS; or an adenosine deaminase (e.g., a first or a second adenosine deaminase) and an NLS.

In some embodiments, any of the fusion proteins provided herein, comprise an adenosine deaminase and a napDNAbp that are fused to each other via a linker. In some embodiments, any of the fusion proteins provided herein, comprise a first adenosine deaminase and a second adenosine deaminase that are fused to each other via a linker. In some embodiments, any of the fusion proteins provided herein, comprise an NLS, which may be fused to an adenosine deaminase (e.g., a first and/or a second adenosine deaminase), a nucleic acid programmable DNA binding protein (napDNAbp), and or an inhibitor of base repair (IBR). Various linker lengths and flexibilities between an adenosine deaminase (e.g., an engineered ecTadA) and a napDNAbp (e.g., a Cas9 domain), and/or between a first adenosine deaminase and a second adenosine deaminase can be employed (e.g., ranging from very flexible linkers of the form (GGGGS)n (SEQ ID NO: 38), (GGGGS)n (SEQ ID NO: 39), and (G)n to more rigid linkers of the form (EAAAK)n (SEQ ID NO: 40), (SGGS)n (SEQ ID NO: 37), SGSETPGTSESATPES (SEQ ID NO: 10) (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference) and (XP)$_n$) in order to achieve the optimal length for deaminase activity for the specific application. In some embodiments, n is 1, 2, 3, 4, 5, 6, 7, 8, 9, 10, 11, 12, 13, 14, or 15. In some embodiments, the linker comprises a (GGS)$_n$ motif, wherein n is 1, 3, or 7. In some embodiments, the adenosine deaminase and the napDNAbp, and/or the first adenosine deaminase and the second adenosine deaminase of any of the fusion proteins provided herein are fused via a linker comprising the amino acid sequence SGSETPGTSESATPES (SEQ ID NO: 10), SGGS (SEQ ID NO: 37), SGGSSGSETPGTSESATPESSGGS (SEQ ID NO: 384), SGGSSGGSSSGSETPGTSESATPESSGGSSGGS (SEQ ID NO: 385), or GGSGGSPGSPAGSPTSTEEGTSESAT-PESGPGTSTEPSEGSAPGSPAGSPTSTEEGTSTE PSEGSAPGTSTEPSEGSAPGTSESAT-PESGPGSEPATSGGSGGS (SEQ ID NO: 386). In some embodiments, the linker is 24 amino acids in length. In some embodiments, the linker comprises the amino acid sequence SGGSSGGSSSGSETPGTSESATPES (SEQ ID NO: 685). In some embodiments, the linker is 40 amino acids in length. In some embodiments, the linker comprises the amino acid sequence SGGSSGGSSSGSETPGTSESAT-PESSGGSSGGSSGGSSGGS (SEQ ID NO: 686). In some embodiments, the linker is 64 amino acids in length. In some embodiments, the linker comprises the amino acid sequence SGGSSGGSSSGSETPGTSESAT-PESSGGSSGGSSGGSSGGSSGGSSGSETPGTSESAT-PESSGGS SGGS (SEQ ID NO: 687). In some embodiments, the linker is 92 amino acids in length. In some embodiments, the linker comprises the amino acid sequence (SEQ ID NO: 688)
PGSPAGSPTSTEEGTSESATPESGPGTSTEPSEGSAPGSPAGSPTSTEEG

TSTEPSEGSAPGTSTEPSEGSAPGTSESATPESGPGSEPATS.

Some aspects of the disclosure provide fusion proteins comprising a Cas9 domain and an adenosine deaminase. Exemplary fusion proteins include, without limitation, the following fusion proteins (for the purposes of clarity, the adenosine deaminase domain is shown in Bold; mutations of the ecTadA deaminase domain are shown in Bold underlining; the XTEN linker is shown in italics; the UGI/AAG/EndoV domains are shown in Bold italics; and NLS is shown in underlined italics):

ecTadA(wt)-XTEN-nCas9-NLS:
(SEQ ID NO: 11)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

-continued

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*PKKKRKV* ecTadA(D108N)-XTEN-nCas9-NLS: (mammalian construct, active on DNA, A to G editing):

(SEQ ID NO: 12)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

AR<u>N</u>AKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS_PKKKRKV_

-continued ecTadA(D108G)-XTEN-nCas9-NLS: (mammalian construct, active on DNA, A to G editing):

(SEQ ID NO: 13)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARG̲AKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS_PKKKRKV_ ecTadA(D108V)-XTEN-nCas9-NLS: (mammalian construct, active on DNA, A to G editing):

(SEQ ID NO: 14)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARV̲AKTGAAGSLMDVLHHPGMNHRVEITEGILADECAALLSDFFRMRRQEIKA

QKKAQSSTDSGSETPGTSESATPESDKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

-continued

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*PKKKRKV* ecTadA(D108N)-XTEN-nCas9-UGI-NLS (BE3 analog of A to G editor):

(SEQ ID NO: 15)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

-continued

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGD SGGS *TNLSDIIEKETGKQLVIQESILMLPEEVEEVIGNKPESDILVHT*

*AYDESTDENVMLLTSDAPEYKPWALVIQDSNGENKIKML*SGGS PKKKRKV ecTadA(D108G)-XTEN-nCas9-UGI-NLS (BE3 analog of A to G editor):

(SEQ ID NO: 16)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARGAKTGAAGSLMDVLHHPGMNHRVEITEGILADECAALLSDFFRMRRQEIKA

QKKAQSSTD *SGSETPGTSESATPES* DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGD SGGS *TNLSDIIEKETGKQLVIQESILMLPEEVEEVIGNKPESDILVHT*

*AYDESTDENVMLLTSDAPEYKPWALVIQDSNGENKIKML*SGGS PKKKRKV

-continued ecTadA(D108V)-XTEN-nCas9-UGI-NLS (BE3 analog of A to G editor):
(SEQ ID NO: 17)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARV̲AKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGSTNLSDIIEKETGKQLVIQESILMLPEEVEEVIGNKPESDILVHT

AYDESTDENVMLLTSDAPEYKPWALVIQDSNGENKIKMLSGGS PKKKRKV ecTadA(D108N)-XTEN-dCas9-UGI-NLS (mammalian cells, BE2 analog of A to G editor):
(SEQ ID NO: 18)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARN̲AKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*TNLSDIIEKETGKQLVIQESILMLPEEVEEVIGNKPESDILVHT*

*AYDESTDENVMLLTSDAPEYKPWALVIQDSNGENKIKML*SGGS<u>PKKKRKV</u> ecTadA(D108G)-XTEN-dCas9-UGI-NLS (mammalian cells, BE2 analog of A to G editor):

(SEQ ID NO: 19)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

AR<u>G</u>AKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

IVPQSFLKDDSIDNKVLTRSDKNRGKSDNVPSEEVVKKMKNYWRQLLNAKLITQRK

-continued

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*TNLSDIIEKETGKQLVIQESILMLPEEVEEVIGNKPESDILVHT*

*AYDESTDENVMLLTSDAPEYKPWALVIQDSNGENKIKML*SGGS PKKKRKV ecTadA(D108V)-XTEN-dCas9-UGI-NLS (mammalian cells, BE2 analog of A to G
editor):

(SEQ ID NO: 20)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARV̲AKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

-continued

TRIDLSQLGGDSGGS*TNLSDIIEKETGKQLVIQESILMLPEEVEEVIGNKPESDILVHT*

*AYDESTDENVMLLTSDAPEYKPWALVIQDSNGENKIKML*SGGS<u>PKKKRKV</u> ecTadA(D108N)-XTEN-nCas9-AAG(E125Q)-NLS-cat. alkyladenosine glycosylase:
(SEQ ID NO: 21)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

AR<u>N</u>AKTGAAGSLMDVLHHPGMNHRVEITEGILADECAALLSDFFRMRRQEIKA

QKKAQSSTD*SGSETPGTSESATPES*<u>DKKYSIGLAIGTNSVGWAVITDEYKVPSKKFKV</u>

<u>LGNTDRHSIKKNLIGALLFDSGETAEATRLKRTARRRYTRRKNRICYLQEIFSNEMAK</u>

<u>VDDSFFHRLEESFLVEEDKKHERHPIFGNIVDEVAYHEKYPTIYHLRKKLVDSTDKAD</u>

<u>LRLIYLALAHMIKFRGHFLIEGDLNPDNSDVDKLFIQLVQTYNQLFEENPINASGVDA</u>

<u>KAILSARLSKSRRLENLIAQLPGEKKNGLFGNLIALSLGLTPNFKSNFDLAEDAKLQLS</u>

<u>KDTYDDDLDNLLAQIGDQYADLFLAAKNLSDAILLSDILRVNTEITKAPLSASMIKRY</u>

<u>DEHHQDLTLLKALVRQQLPEKYKEIFFDQSKNGYAGYIDGGASQEEFYKFIKPILEK</u>

<u>MDGTEELLVKLNREDLLRKQRTFDNGSIPHQIHLGELHAILRRQEDFYPFLKDNREKI</u>

<u>EKILTFRIPYYVGPLARGNSRFAWMTRKSEETITPWNFEEVVDKGASAQSFIERMTNF</u>

<u>DKNLPNEKVLPKHSLLYEYFTVYNELTKVKYVTEGMRKPAFLSGEQKKAIVDLLFK</u>

<u>TNRKVTVKQLKEDYFKKIECFDSVEISGVEDRFNASLGTYHDLLKIIKDKDFLDNEEN</u>

<u>EDILEDIVLTLTLFEDREMIEERLKTYAHLFDDKVMKQLKRRRYTGWGRLSRKLINGI</u>

<u>RDKQSGKTILDFLKSDGFANRNFMQLIHDDSLTFKEDIQKAQVSGQGDSLHEHIANL</u>

<u>AGSPAIKKGILQTVKVVDELVKVMGRHKPENIVIEMARENQTTQKGQKNSRERMKR</u>

<u>IEEGIKELGSQILKEHPVENTQLQNEKLYLYYLQNGRDMYVDQELDINRLSDYDVDH</u>

<u>IVPQSFLKDDSIDNKVLTRSDKNRGKSDNVPSEEVVKKMKNYWRQLLNAKLITQRK</u>

<u>FDNLTKAERGGLSELDKAGFIKRQLVETRQITKHVAQILDSRMNTKYDENDKLIREV</u>

<u>KVITLKSKLVSDFRKDFQFYKVREINNYHHAHDAYLNAVVGTALIKKYPKLESEFVY</u>

<u>GDYKVYDVRKMIAKSEQEIGKATAKYFFYSNIMNFFKTEITLANGEIRKRPLIETNGE</u>

<u>TGEIVWDKGRDFATVRKVLSMPQVNIVKKTEVQTGGFSKESILPKRNSDKLIARKKD</u>

<u>WDPKKYGGFDSPTVAYSVLVVAKVEKGKSKKLKSVKELLGITIMERSSFEKNPIDFL</u>

<u>EAKGYKEVKKDLIIKLPKYSLFELENGRKRMLASAGELQKGNELALPSKYVNFLYLA</u>

<u>SHYEKLKGSPEDNEQKQLFVEQHKHYLDEIIEQISEFSKRVILADANLDKVLSAYNKH</u>

<u>RDKPIREQAENIIHLFTLTNLGAPAAFKYFDTTIDRKRYTSTKEVLDATLIHQSITGLYE</u>

<u>TRIDLSQLGGDSGGS</u>*KGHLTRLGLEFFDQPAVPLARAFLGQ*

*VETQAYLGPEDEAAHSRGGRQTPRNGMFMKPGTLYVYIIYGMYFCMNISSQGDGA*

*CVLLRALEPLEGLETMRQLRSTLRKGTASRVLKDRELCSGPSKLCQALAINKSFDQR*

*DLAQDEAVWLERGPLEPSEPAVVAAARVGVGHAGEWARKPLRFYVRGSPWVSVVD*

*RVAEQDTQA*SGGS<u>PKKKRKV</u> ecTadA(D108G)-XTEN-nCas9-AAG(E125Q)-NLS-cat. alkyladenosine glycosylase:
(SEQ ID NO: 22)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

AR<u>G</u>AKTGAAGSLMDVLHHPGMNHRVEITEGILADECAALLSDFFRMRRQEIKA

QKKAQSSTD*SGSETPGTSESATPES*<u>DKKYSIGLAIGTNSVGWAVITDEYKVPSKKFKV</u>

-continued

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*KGHLTRLGLEFFDQPAVPLARAFLGQVLVRRLPNGTELRGRI*

*VETQAYLGPEDEAAHSRGGRQTPRNRGMFMKPGTLYVYIIYGMYFCMNISSQGDGA*

*CVLLRALEPLEGLETMRQLRSTLRKGTASRVLKDRELCSGPSKLCQALAINKSFDQR*

*DLAQDEAVWLERGPLEPSEPAVVAAARVGVHAGEWARKPLRFYVRGSPWVSVVD*

*RVAEQDTQA*SGGSPKKKRKV ecTadA(D108V)-XTEN-nCas9-AAG(E125Q)-NLS-cat. alkyladenosine glycosylase:
(SEQ ID NO: 23)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARVAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

-continued

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*KGHLTRLGLEFFDQPAVPLARAFLGQVLVRRLPNGTELRGRI*

*VETQAYLGPEDEAAHSRGGRQTPRNRGMFMKPGTLYVYIIYGMYFCMNISSQGDGA*

*CVLLRALEPLEGLETMRQLRSTLRKGTASRVLKDRELCSGPSKLCQALAINKSFDQR*

*DLAQDEAVWLERGPLEPSEPAVVAAAR VGVGHAGEWARKPLRFYVRGSPWVSVVD*

*RVAEQDTQA*SGGS<u>PKKKRKV</u> ecTadA(D108N)-XTEN-nCas9-EndoV(D35A)-NLS: contains cat. endonuclease V:
(SEQ ID NO: 24)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

AR<u>N</u>AKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

-continued

IVPQSFLKDDSIDNKVLTRSDKNRGKSDNVPSEEVVKKMKNYWRQLLNAKLITQRK
FDNLTKAERGGLSELDKAGFIKRQLVETRQITKHVAQILDSRMNTKYDENDKLIREV
KVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKYVNFLYLA
SHYEKLKGSPEDNEQKQLFVEQHKHYLDEIIEQISEFSKRVILADANLDKVLSAYNKH
RDKPIREQAENIIHLFTLTNLGAPAAFKYFDTTIDRKRYTSTKEVLDATLIHQSITGLYE
TRIDLSQLGGDSGGS*DLASRAQQIELASSVIREDRLDKDPPDLIAGAAVGFEQGGEV*
*TRAAMVLLKYPSLELVEYKVARIATTMPYIPGFLSFREYPAILAAWEMLSQKPDLVF*
*VDGHGISHPRRLGVASHFGLLVDVPTIGVAKKRLCGKFEPLSSEPGALAPLMDKGEQ*
*LAWVWRSKARCNPLFIATGHRVSVDSALAWVQRCM*KGYRLPEPTRWA*DAVASERPA*
*FVRYTANQP*SGGS PKKKRKV ecTadA(D108G)-XTEN-nCas9-EndoV(D35A)-NLS: contains cat. endonuclease V:
(SEQ ID NO: 25)
MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARGAKTGAAGSLMDVLHHPGMNHRVEITEGILADECAALLSDFFRMRRQEIKA
QKKAQSSTD*SGSETPGTSESATPES*DKKYSIGLAIGTNSVGWAVITDEYKVPSKKFKV
LGNTDRHSIKKNLIGALLFDSGETAEATRLKRTARRRYTRRKNRICYLQEIFSNEMAK
VDDSFFHRLEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENPINASGVDA
KAILSARLSKSRRLENLIAQLPGEKKNGLFGNLIALSLGLTPNFKSNFDLAEDAKLQLS
KDTYDDDLDNLLAQIGDQYADLFLAAKNLSDAILLSDILRVNTEITKAPLSASMIKRY
DEHHQDLTLLKALVRQQLPEKYKEIFFDQSKNGYAGYIDGGASQEEFYKFIKPILEK
MDGTEELLVKLNREDLLRKQRTFDNGSIPHQIHLGELHAILRRQEDFYPFLKDNREKI
EKILTFRIPYYVGPLARGNSRFAWMTRKSEETITPWNFEEVVDKGASAQSFIERMTNF
DKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDFLDNEEN
EDILEDIVLTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNSRERMKR
IEEGIKELGSQILKEHPVENTQLQNEKLYLYYLQNGRDMYVDQELDINRLSDYDVDH
IVPQSFLKDDSIDNKVLTRSDKNRGKSDNVPSEEVVKKMKNYWRQLLNAKLITQRK
FDNLTKAERGGLSELDKAGFIKRQLVETRQITKHVAQILDSRMNTKYDENDKLIREV
KVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKYTSTKEVLDATLIHQSITGLYE

TRIDLSQLGGDSGGS*DLASLRAQQIELASSVIREDRLDKDPPDLIAGAAVGFEQGGEV*

*TRAAMVLLKYPSLELVEYKVARIATTMPYIPGFLSFREYPALLAAWEMLSQKPDLVF*

*VDGHGISHPRRLGVASHFGLLVDVPTIGVAKKRLCGKFEPLSSEPGALAPLMDKGEQ*

*LAWVWRSKARCNPLFIATGHRVSVDSALAWVQRCMKGYRLPEPTRWADAVASERPA*

*FVRYTANQP*SGGS PKKKRKV ecTadA(D108V)-XTEN-nCas9-EndoV(D35A)-NLS: contains cat. endonuclease V:
(SEQ ID NO: 26)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARVAKTGAAGSLMDVLHHPGMNHRVEITEGILADECAALLSDFFRMRRQEIKA

QKKAQSSTDSGSETPGTSESATPESDKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKYTSTKEVLDATLIHQSITGLYE

TRIDLSQLGGDSGGS*DLASLRAQQIELASSVIREDRLDKDPPDLIAGAAVGFEQGGEV*

*TRAAMVLLKYPSLELVEYKVARIATTMPYIPGFLSFREYPALLAAWEMLSWQKPDLVF*

*VDGHGISHPRRLGVASHFGILVDVPTIGVAKKRLCGKFEPLSSEPGALAPLMDKGEQ*

*LAWVWRSKARCNLFIATGHRVSVDSALAWVQRCMKGYRLPEPTRWADAVASERPA*

*FVRYTANQP*SGGS PKKKRKV

-continued

Variant resulting from first round of evolution (in bacteria) ecTadA (H8Y_D108N_N127S)-XTEN-dCas9:

(SEQ ID NO: 27)

MSEVEFSYEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMSHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGD

Enriched variants from second round of evolution (in bacteria) ecTadA (H8Y_D108N_N127S_E155X)-XTEN-dCas9; X = D, G or V:

(SEQ ID NO: 28)

MSEVEFSYEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMSHRVEITEGILADECAALLSDFFRMRRQXIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGD ecTadA*-XTEN-nCas9-GGS-DNA repair inhibitor-GGS-NLS (Inhibitor = UGI,
AAG*E125Q or EndoV*D35A)
pNMG-160: ecTadA(D108N)-XTEN-nCas9-GGS-AAG*(E125Q)-GGS-NLS (SEQ ID NO: 387)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV
KVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKYVNFLYLA
SHYEKLKGSPEDNEQKQLFVEQHKHYLDEIIEQISEFSKRVILADANLDKVLSAYNKH
RDKPIREQAENIIHLFTLTNLGAPAAFKYFDTTIDRKRYTSTKEVLDATLIHQSITGLYE
TRIDLSQLGGDGGS*KGHLTRLGLEFFDQPAVPLARAFLGQVLVRRLPNGTELRGRIV*
*ETQAYLGPEDEAAHSRGGRQTPRNRGMFMKPGTLYVYIIYGMYFCMNISSQGDAC*
*VLLRALEPLEGLETMRQLRSTLRKGTASRVLKDRELCSGPSKLCQALAINKSFDQRD*
*LAQDEAVWLERGPLEPSEPAVVAAARVGVHAGEWARKPLRFYVRGSPWVSVVDR*
*VAEQDTQA*GGS*PKKKRKV* pNMG-161: ecTadA(D108N)-XTEN-nCas9-GGS-EndoV*(D35A)-GGS-NLS  (SEQ ID NO: 388)

MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARNAKTGAAGSLMDVLHHPGMNHRVEITEGILADECAALLSDFFRMRRQEIKA
QKKAQSSTD*SGSETPGTSESATPES*DKKYSIGLAIGTNSVGWAVITDEYKVPSKKFKV
LGNTDRHSIKKNLIGALLFDSGETAEATRLKRTARRRYTRRKNRICYLQEIFSNEMAK
VDDSFFHRLEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENPINASGVDA
KAILSARLSKSRRLENLIAQLPGEKKNGLFGNLIALSLGLTPNFKSNFDLAEDAKLQLS
KDTYDDDLDNLLAQIGDQYADLFLAAKNLSDAILLSDILRVNTEITKAPLSASMIKRY
DEHHQDLTLLKALVRQQLPEKYKEIFFDQSKNGYAGYIDGGASQEEFYKFIKPILEK
MDGTEELLVKLNREDLLRKQRTFDNGSIPHQIHLGELHAILRRQEDFYPFLKDNREKI
EKILTFRIPYYVGPLARGNSRFAWMTRKSEETITPWNFEEVVDKGASAQSFIERMTNF
DKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDFLDNEEN
EDILEDIVLTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNSRERMKR
IEEGIKELGSQILKEHPVENTQLQNEKLYLYYLQNGRDMYVDQELDINRLSDYDVDH
IVPQSFLKDDSIDNKVLTRSDKNRGKSDNVPSEEVVKKMKNYWRQLLNAKLITQRK
FDNLTKAERGGLSELDKAGFIKRQLVETRQITKHVAQILDSRMNTKYDENDKLIREV
KVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKYVNFLYLA
SHYEKLKGSPEDNEQKQLFVEQHKHYLDEIIEQISEFSKRVILADANLDKVLSAYNKH

-continued

RDKPIREQAENIIHLFTLTNLGAPAAFKYFDTTIDRKRYTSTKEVLDATLIHQSITGLYE

TRIDLSQLGGDGGS*DLASLRAQQIELASSVIREDRLDKDPPDLIAGAAVGFEQGGEVT*

*RAAMVLLKYPSLELVEYKVARATTMPYIPGFLSFREYPALLAAWEMLSQKPDLVFV*

*DGHGISHPRRLGVASHFGLLVDVPTIGVAKKRLCGKFEPISSEPGALAPLMDKGEQL*

*AWVWRSKARCNPLFIATGHRVSVDSALAWVQRCMKGYRLPEPTRWADAVASERPA*

*FVRYTANQP* GGS PKKKRKV pNMG-371: ecTadA(L84F_A106V_D108N_H123Y_D147Y_E155V_I156F)-SGGS-
SGGS-SGGS-XTEN-SGGS-SGGS-
ecTadA(L84F_A106V_D108N_H123Y_D147Y_E155V_I156F)-SGGS-SGGS-XTEN-
SGGS-SGGS-nCas9-SGGS-NLS (SEQ ID NO: 440)

SEVEFSHEYWMRHALTLAKRAWDEREVPVGAVLVHNNRVIGEGWNRPIGRHD

PTAHAEIMALRQGGLVMQNYRLIDATLYVTFEPCVMCAGAMIHSRIGRVVFGV

RNAKTGAAGSLMDVLHYPGMNHRVEITEGILADECAALLSYFFRMRRQVFKAQ

KKAQSSTD*SGGSSGGSSGSETPGTSESATPESSGGSSGGS*SEVEFSHEYWMRHALTL

AKRAWDEREVPVGAVLVHNNRVIGEGWNRPIGRHDPTAHAEIMALRQGGLVM

QNYRLIDATLYVTFEPCVMCAGAMIHSRIGRVVFGVRNAKTGAAGSLMDVLHY

PGMNHRVEITEGILADECAALLSYFFRMRRQVFKAQKKAQSSTDSGGSSGGS*SGS*

*ETPGTSESATPESS*GGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDS

FFHRLEESFLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINASGVDAKAIL

SARLSKSRRLENLIAQLPGEKKNGLFGNLIALSLGLTPNFKSNFDLAEDAKLQLSKDT

YDDDLDNLLAQIGDQYADLFLAAKNLSDAILLSDILRVNTEITKAPLSASMIKRYDEH

HQDLTLLKALVRQQLPEKYKEIFFDQSKNGYAGYIDGGASQEEFYKFIKPILEKMDG

TEELLVKLNREDLLRKQRTFDNGSIPHQIHLGELHAILRRQEDFYPFLKDNREKIEKIL

TFRIPYYVGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILE

DIVLTLTLFEDREMIEERLKTYAHLFDDKVMKQLKRRYTGWGRLSRKLINGIRDKQ

SGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIK

ELGSQILKEHPVENTQLQNEKLYLYYLQNGRDMYVDQELDINRLSDYDVDHIVPQSF

LKDDSIDNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETNGETGEIWD

KGRDFATVRKVLSMPQVNIVKKTEVQTGGFSKESILPKRNSDKLIARKKDWDPKKY

GGFDSPTVAYSVLVVAKVEKGKSKKLKSVKELLGITIMERSSFEKNPIDFLEAKGYKE

VKKDLIIKLPKYSLFELENGRKRMLASAGELQKGNELALPSKYVNFLYLASHYEKLK

GSPEDNEQKQLFVEQHKHYLDEIIEQISEFSKRVILADANLDKVLSAYNKHRDKPIRE

QAENIIHLFTLTNLGAPAAFKYFDTTIDRKRYTSTKEVLDATLIHQSITGLYETRIDLSQ

LGGDSGGS PKKKRKV pNMG-616 amino acid sequence: ecTadA$_{(wild\ type)}$-(SGGS)2-XTEN-(SGGS)2-
ecTadA$_{(W23L\_H36L\_P48A\_R51L\_L84F\_A106V\_D108N\_H123Y\_S146C\_D147Y\_R152P\_E155V\_I156F\_K157N)}$-
(SGGS)2-XTEN-(SGGS)2_nCas9_SGGS_NLS (SEQ ID NO: 691)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGSSGSETPGTSESATPESSGGSSGGSSEVEFSHEYWMRHALT

LAKRALDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMPRQVFNAQKKAQSSTDSGGSSGGSS

GSETPGTSESATPESSGGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-624 amino acid sequence: ecTadA$_{(wild\ type)}$-32 a.a. linker-
ecTadA$_{(W23R\_H36L\_P48A\_R51L\_L84F\_A106V\_D108N\_H123Y\_S146C\_D147Y\_R152P\_E155V\_I156F\_K157N)}$-
24 a.a. linker_nCas9_SGGS_NLS (SEQ ID NO: 692)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGSSGSETPGTSESATPESSGGSSGGSSEVEFSHEYWMRHALTL

AKRARDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHY

PGMNHRVEITEGILADECAALLCYFFRMPRQVFNAQKKAQSSTD*SGGSSGGSSGS*

*ETPGTSESATPES*DKKYSIGLAIGTNSVGWAVITDEYKVPSKKFKVLGNTDRHSIKKNL

IGALLFDSGETAEATRLKRTARRRYTRRKNRICYLQEIFSNEMAKVDDSFFHRLEESF

LVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSR

RLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLL

KALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNLPNEKVLP

KHSLLYEYFTVYNELTKVKYVTEGMRKPAFLSGEQKKAIVDLLFKTNRKVTVKQLK

EDYFKKIECFDSVETSGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILK

EHPVENTQLQNEKLYLYYLQNGRDMYVDQELDINRLSDYDVDHIVPQSFLKDDSID

NKVLTRSDKNRGKSDNVPSEEVVKKMKNYWRQLLNAKLITQRKFDNLTKAERGGL

SELDKAGFIKRQLVETRQnKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPlREQAENIIH

LFTLTNLGAPAAFKYFDTTIDRKRYTSTKEVLDATLIHQSITGLYETRlDLSQLGGDSG

GS*PKKKRK*V pNMG-476 amino acid sequence (evolution #3 hetero dimer, wt TadA + TadA evo #3 mutations): ecTadA$_{(wild-type)}$-(SGGS)2-XTEN-(SGGS)2-ecTadA$_{(L84F\_A106V\_D108N\_H123Y\_D147Y\_E155V\_I156F)}$-(SGGS)2-XTEN-(SGGS)2_nCas9_SGGS_NLS (SEQ ID NO: 693)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESSGGSSGGS*SEVEFSHEYWMRHALT

LAKRAWDEREVPVGAVLVHNNRVIGEGWNRPIGRHDPTAHAEIMALRQGGLV

MQNYRLIDATLYVTFEPCVMCAGAMIHSRIGRVVFGVRNAKTGAAGSLMDVLH

YPGMNHRVEITEGILADECAALLSYFFRMRRQVFKAQKKAQSSTD*SGGSSGGSS*

*GSETPGTSESATPESSGGSSGGS*DKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-477 amino acid sequence: ecTadA$_{(wild-type)}$-(SGGS)2-XTEN-(SGGS)2-ecTadA$_{(H36L\_R51L\_L84F\_A106V\_D108N\_H123Y\_S146C\_D147Y\_E155V\_I156F\_K57N)}$-(SGGS)2-XTEN-(SGGS)2\_nCas9\_SGGS\_NLS (SEQ ID NO: 694)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESS*GGSSGGSSEVEFSHEYWMRHALT

LAKRAWDEREVPVGAVLVLNNRVIGEGWNRPIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMRRQVFNAQKKAQSSTD*SGGSSGGSS*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

-continued

KVTVKQLKEDYFKKIECFDSVEISGVEDRFNASLGTYHDLLKIIKDKDFLDNEENEDI
LEDIVLTLTLFEDREMIEERLKTYAHLFDDKVMKQLKRRRYTGWGRLSRKLINTGIRD
KQSGKTILDFLKSDGFANRNFMQLIHDDSLTFKEDIQKAQVSGQGDSLHEHIANLAG
SPAIKKGILQTVKVVDELVKVMGRHKPENIVIEMARENQTTQKGQKNSRERMKRIEE
GIKELGSQILKEHPVENTQLQNEKLYLYYLQNGRDMYVDQELDINRLSDYDVDHIVP
QSFLKDDSIDNKVLTRSDKNRGKSDNVPSEEVVKKMKNYWRQLLNAKLITQRKFDN
LTKAERGGLSELDKAGFIKRQLVETRQITKHVAQILDSRMNTKYDENDKLIREVKVIT
LKSKLVSDFRKDFQFYKVREINNYHHAHDAYLNAVVGTALIKKYPKLESEFVYGDY
KVYDVRKMIAKSEQEIGKATAKYFFYSNIMNFFKTEITLANGEIRKRPLIETNGETGEI
VWDKGRDFATVRKVLSMPQVNIVKKTEVQTGGFSKESILPKRNSDKLIARKKDWDP
KKYGGFDSPTVAYSVLVVAKVEKGKSKKLKSVKELLGITIMERSSFEKNPIDFLEAK
GYKEVKKDLIIKLPKYSLFELENGRKRMLASAGELQKGNELALPSKYVNFLYLASHY
EKLKGSPEDNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQSITGLYETRI
DLSQLGGDSGGS*PKKKRKV* pNMG-558 amino acid sequence: ecTadA$_{(wild-type)}$-32 a.a. linker-
ecTadA$_{(H36L\_R51L\_L84F\_A106V\_D108N\_H123Y\_S146C\_D147Y\_E155V\_I156F\_K157N)}$-
24 a.a. linker_nCas9_SGGS_NLS (SEQ ID NO: 695)

MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARDAKTGAAGSLMDVLHHPGMNHRVEITEGILADECAALLSDFFRMRRQEIKA
QKKAQSSTDSGGSSGGSSGSETPGTSESATPESSGGSSGGSSEVEFSHEYWMRHALTL
AKRAWDEREVPVGAVLVLNNRVIGEGWNRPIGLHDPTAHAEIMALRQGGLVM
QNYRLIDATLYVTFEPCVMCAGAMIHSRIGRVVFGVRNAKTGAAGSLMDVLHY
PGMNHRVEITEGILADECAALLCYFFRMRRQVFNAQKKAQSSTDSGGSSGGSSGS
ETPGTSESATPESDKKYSIGLAIGTNSVGWAVITDEYKVPSKKFKVLGNTDRHSIKKNL
IGALLFDSGETAEATRLKRTARRRYTRRKNRICYLQEIFSNEMAKVDDSFFHRLEESF
LVEEDKKHERHPIFGNIVDEVAYHEKYPTIYHLRKKLVDSTDKADLRLIYLALAHMI
KFRGHFLIEGDLNPDNSDVDKLFIQLVQTYNQLFEENPINASGVDAKAILSARLSKSR
RLENLIAQLPGEKKNGLFGNLIALSLGLTPNFKSNFDLAEDAKLQLSKDTYDDDLDN
LLAQIGDQYADLFLAAKNLSDAILLSDILRVNTEITKAPLSASMIKRYDEHHQDLTLL
KALVRQQLPEKYKEIFFDQSKNGYAGYIDGGASQEEFYKFIKPILEKMDGTEELLVKL
NREDLLRKQRTFDNGSIPHQIHLGELHAILRRQEDFYPFLKDNREKIEKILTFRIPYYV
GPLARGNSRFAWMTRKSEETITPWNFEEVVDKGASAQSFIERMTNFDKNLPNEKVLP
KHSLLYEYFTVYNELTKVKYVTEGMRKPAFLSGEQKKAIVDLLFKTNRKVTVKQLK
EDYFKKIECFDSVETSGVEDRFNASLGTYHDLLKIIKDKDFLDNEENEDILEDIVLTLTL
FEDREMIEERLKTYAHLFDDKVMKQLKRRRYTGWGRLSRKLINGIRDKQSGKTILDF
LKSDGFANRNFMQLIHDDSLTFKEDIQKAQVSGQGDSLHEHIANLAGSPAIKKGILQT
VKVVDELVKVMGRHKPENIVIEMARENQTTQKGQKNSRERMKRIEEGIKELGSQILK
EHPVENTQLQNEKLYLYYLQNGRDMYVDQELDINRLSDYDVDHIVPQSFLKDDSID
NKVLTRSDKNRGKSDNVPSEEVVKKMKNYWRQLLNAKLITQRKFDNLTKAERGGL

-continued

SELDKAGFIKRQLVETRQnKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGDSG

GS*PKKKRKV* pNMG-576 amino acid sequence: ecTadA$_{(wild-type)}$-(SGGS)2-XTEN-(SGGS)2-
ecTadA$_{(H36L\_P48S\_R51L\_L84F\_A106V\_D108N\_H123Y\_S146C\_D147Y\_E155V\_I156F\_K157N)}$-
(SGGS)2-XTEN-(SGGS)2\_nCas9\_GGS\_NLS (SEQ ID NO: 696)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESSGGSSGGSSEVEFSHEYWMRHALT

LAKRAWDEREVPVGAVLVLNNRVIGEGWNRSIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMRRQVFNAQKKAQSSTDSGGSSGGS*S*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINTGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

-continued

PIREQAENIIHLFTLTNLGAPAAFKYFDTTIDRKRYTSTKEVLDATLIHQSITGLYETRI

DLSQLGGDSGGSPKKKRKV pNMG-577 amino acid sequence: ecTadA$_{(wild-type)}$-(SGGS)2-XTEN-(SGGS)2-
ecTadA$_{(H36L\_P48S\_R51L\_L84F\_A106V\_D108N\_H123Y\_S146C\_A142N\_D147Y\_E155V\_I156F\_K57N)}$-
(SGGS)2-XTEN-(SGGS)2_nCas9_GGS_NLS (SEQ ID NO: 697)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESS*GGSSGGSSEVEFSHEYWMRHALT

LAKRAWDEREVPVGAVLVLNNRVIGEGWNRSIGLHDPTAHAEIMALRQGGLV

MQNYRLIDATLYVTFEPCVMCAGAMIHSRIGRVVFGVRNAKTGAAGSLMDVLH

YPGMNHRVEITEGILADECNALLCYFFRMRRQVFNAQKKAQSSTD*SGGSSGGSS*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINTGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-586 amino acid sequence: ecTadA$_{(wild-type)}$-(SGGS)2-XTEN-(SGGS)2-
ecTadA$_{(H36L\_P48A\_R51L\_L84F\_A106V\_D108N\_H123Y\_S146C\_D147Y\_E155V\_I156F\_K57N)}$-
(SGGS)2-XTEN-(SGGS)2_nCas9_GGS_NLS (SEQ ID NO: 698)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD<i>SGGSSGGSSGSETPGTSESATPESSGGSSGGS</i>SEVEFSHEYWMRHALT

LAKRAWDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMRRQVFNAQKKAQSSTD<i>SGGSSGGSS</i>

<i>GSETPGTSESATPESSGGSSGGS</i><u>DKKYSIGLAIGTNSVGWAVITDEYKVPSKKFKVLGN</u>

<u>TDRHSIKKNLIGALLFDSGETAEATRLKRTARRRYTRRKNRICYLQEIFSNEMAKVDD</u>

<u>SFFHRLEESFLVEEDKKHERHPIFGNIVDEVAYHEKYPTIYHLRKKLVDSTDKADLRL</u>

<u>IYLALAHMIKFRGHFLIEGDLNPDNSDVDKLFIQLVQTYNQLFEENPINASGVDAKAI</u>

<u>LSARLSKSRRLENLIAQLPGEKKNGLFGNLIALSLGLTPNFKSNFDLAEDAKLQLSKD</u>

<u>TYDDDLDNLLAQIGDQYADLFLAAKNLSDAILLSDILRVNTEITKAPLSASMIKRYDE</u>

<u>HHQDLTLLKALVRQQLPEKYKEIFFDQSKNGYAGYIDGGASQEEFYKFIKPILEKMD</u>

<u>GTEELLVKLNREDLLRKQRTFDNGSIPHQIHLGELHAILRRQEDFYPFLKDNREKIEKI</u>

<u>LTFRIPYYVGPLARGNSRFAWMTRKSEETITPWNFEEVVDKGASAQSFIERMTNFDK</u>

<u>NLPNEKVLPKHSLLYEYFTVYNELTKVKYVTEGMRKPAFLSGEQKKAIVDLLFKTNR</u>

<u>KVTVKQLKEDYFKKIECFDSVEISGVEDRFNASLGTYHDLLKIIKDKDFLDNEENEDI</u>

<u>LEDIVLTLTLFEDREMIEERLKTYAHLFDDKVMKQLKRRRYTGWGRLSRKLINTGIRD</u>

<u>KQSGKTILDFLKSDGFANRNFMQLIHDDSLTFKEDIQKAQVSGQGDSLHEHIANLAG</u>

<u>SPAIKKGILQTVKVVDELVKVMGRHKPENIVIEMARENQTTQKGQKNSRERMKRIEE</u>

<u>GIKELGSQILKEHPVENTQLQNEKLYLYYLQNGRDMYVDQELDINRLSDYDVDHIVP</u>

<u>QSFLKDDSIDNKVLTRSDKNRGKSDNVPSEEVVKKMKNYWRQLLNAKLITQRKFDN</u>

<u>LTKAERGGLSELDKAGFIKRQLVETRQITKHVAQILDSRMNTKYDENDKLIREVKVIT</u>

<u>LKSKLVSDFRKDFQFYKVREINNYHHAHDAYLNAVVGTALIKKYPKLESEFVYGDY</u>

<u>KVYDVRKMIAKSEQEIGKATAKYFFYSNIMNFFKTEITLANGEIRKRPLIETNGETGEI</u>

<u>VWDKGRDFATVRKVLSMPQVNIVKKTEVQTGGFSKESILPKRNSDKLIARKKDWDP</u>

<u>KKYGGFDSPTVAYSVLVVAKVEKGKSKKLKSVKELLGITIMERSSFEKNPIDFLEAK</u>

<u>GYKEVKKDLIIKLPKYSLFELENGRKRMLASAGELQKGNELALPSKYVNFLYLASHY</u>

<u>EKLKGSPEDNEQKQLFVEQHKHYLDEIIEQISEFSKRVILADANLDKVLSAYNKHRDK</u>

<u>PIREQAENIIHLFTLTNLGAPAAFKYFDTTIDRKRYTSTKEVLDATLIHQSITGLYETRI</u>

<u>DLSQLGGD</u>SGGS<u><i>PKKKRKV</i></u> pNMG-588 amino acid sequence: ecTadA<sub>(wild-type)</sub>-(SGGS)2-XTEN-(SGGS)2-
ecTadA<sub>(H36L_P48A_R51L_L84F_A106V_D108N_H123Y_S146C_A142N_D147Y_E155V_I156F_K157N)</sub>-
(SGGS)2-XTEN-(SGGS)2_nCas9_GGS_NLS (SEQ ID NO: 699)

MSEVEFSHEYWMRHALTLAKRAWDEREVPVGAVLHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD<i>SGGSSGGSSGSETPGTSESATPESSGGSSGGS</i>SEVEFSHEYWMRHALT

LAKRAWDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECNALLCYFFRMRRQVFNAQKKAQSSTD<i>SGGSSGGSS</i>

<i>GSETPGTSESATPESSGGSSGGS</i><u>DKKYSIGLAIGTNSVGWAVITDEYKVPSKKFKVLGN</u>

<u>TDRHSIKKNLIGALLFDSGETAEATRLKRTARRRYTRRKNRICYLQEIFSNEMAKVDD</u>

-continued

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINTGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-620 amino acid sequence: ecTadA$_{(wild-type)}$-(SGGS)2-XTEN-(SGGS)2-
ecTadA$_{(W23R\_H36L\_P48A\_R51L\_L84F\_A106V\_D108N\_H123Y\_S146C\_D147Y\_R152P\_E155V\_I156F\_K157N)}$-
(SGGS)2-XTEN-(SGGS)2_nCas9_GGS_NLS (SEQ ID NO: 700)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESS*GGSSGGSSEVEFSHEYWMRHALT

LAKRARDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMPRQVFNAQKKAQSSTDSGGSSGGSS

GSETPGTSESATPESSGGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-617 amino acid sequence: ecTadA(wi/d-type)-(SGGS)2-XTEN-(SGGS)2-
ecTadA(W23L_H36L_P48A_R51L_L84F_A106V_D108N_H123Y_A142A_S146C_D147Y_E155V_I156F_K157N)-
(SGGS)2-XTEN-(SGGS)2_nCas9_GGS_NLS (SEQ ID NO: 701)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD_SGGSSGGSSGSETPGTSESATPESS_GGSSGGSSEVEFSHEYWMRHALT

LAKRALDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECNALLCYFFRMRRQVFNAQKKAQSSTD_SGGSSGGSS_

_GSETPGTSESATPESSGGSSGGGS_DKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

-continued

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-618 amino acid sequence: ecTadA*(wild-type)*-(SGGS)2-XTEN-(SGGS)2-
ecTadA*(W23L_H36L_P48A_R51L_L84F_A106V_D108N_H123Y_A142A_S146C_D147Y_R152P_E155V_I156F_K157N)*-
(SGGS)2-XTEN-(SGGS)2_nCas9_GGS_NLS (SEQ ID NO: 702)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGSSGSETPGTSESATPESSGGSSGGSSEVEFSHEYWMRHALT

LAKRALDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECNALLCYFFRMPRQVFNAQKKAQSSTDSGGSSGGS*S*

*GSETPGTSESATPESS*GGSSGGS*DKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-620 amino acid sequence: ecTadA$_{(wild-type)}$-(SGGS)2-XTEN-(SGGS)2-ecTadA$_{(W23R\_H36L\_P48A\_R51L\_L84F\_A106V\_D108N\_H123Y\_S146C\_D147Y\_R152P\_E155V\_I156F\_K157N)}$-(SGGS)2-XTEN-(SGGS)2_nCas9_GGS_NLS (SEQ ID NO: 703)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESS*GGSSGGSSEVEFSHEYWMRHALT

LAKRARDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMPRQVFNAQKKAQSSTDSGGSSGGSS

*GSETPGTSESATPESS*SGGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINTGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-621 amino acid sequence: ecTadA$_{(wild-type)}$-32 a.a. linker-ecTadA$_{(H36L\_P48A\_R51L\_L84F\_A106V\_D108N\_H123Y\_S146C\_D147Y\_R152P\_E155V\_I156F\_K157N)}$-24 a.a. linker_nCas9_GGS_NLS (SEQ ID NO: 704)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD_SGGSSGGSSGSETPGTSESATPESSGGSSGGS_SEVEFSHEYWMRHALTL

AKRAWDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHY

PGMNHRVEITEGILADECAALLCYFFRMPRQVFNAQKKAQSSTD_SGGSSGGSSGS_

_ETPGTSESATPES_DKKYSIGLAIGTNSVGWAVITDEYKVPSKKFKVLGNTDRHSIKKNL

IGALLFDSGETAEATRLKRTARRRYTRRKNRICYLQEIFSNEMAKVDDSFFHRLEESF

LVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSR

RLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLL

KALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNLPNEKVLP

KHSLLYEYFTVYNELTKVKYVTEGMRKPAFLSGEQKKAIVDLLFKTNRKVTVKQLK

EDYFKKIECFDSVETSGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILK

EHPVENTQLQNEKLYLYYLQNGRDMYVDQELDINRLSDYDVDHIVPQSFLKDDSID

NKVLTRSDKNRGKSDNVPSEEVVKKMKNYWRQLLNAKLITQRKFDNLTKAERGGL

SELDKAGFIKRQLVETRQITKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGDSG

GS_PKKKRKV_ pNMG-622 amino acid sequence: ecTadA(wild-type)-32 a.a. linker-ecTadA$_{(H36L\_P48A\_R51L\_L84F\_A106V\_D108N\_H123Y\_A142N\_S146C\_D147Y\_R152P\_E155V\_I156F\_K157N)}$-24 a.a. linker_nCas9_GGS_NLS (SEQ ID NO: 705)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD_SGGSSGGSSGSETPGTSESATPESSGGSSGGS_SEVEFSHEYWMRHALTL

AKRAWDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHY

PGMNHRVEITEGILADECNALLCYFFRMPRQVFNAQKKAQSSTD<i>SGGSSGGSSGS</i>

<i>ETPGTSESATPES</i><u>DKKYSIGLAIGTNSVGWAVITDEYKVPSKKFKVLGNTDRHSIKKNL</u>

<u>IGALLFDSGETAEATRLKRTARRRYTRRKNRICYLQEIFSNEMAKVDDSFFHRLEESF</u>

<u>LVEEDKKHERHPIFGNIVDEVAYHEKYPTIYHLRKKLVDSTDKADLRLIYLALAHMI</u>

<u>KFRGHFLIEGDLNPDNSDVDKLFIQLVQTYNQLFEENPINASGVDAKAILSARLSKSR</u>

<u>RLENLIAQLPGEKKNGLFGNLIALSLGLTPNFKSNFDLAEDAKLQLSKDTYDDDLDN</u>

<u>LLAQIGDQYADLFLAAKNLSDAILLSDILRVNTEITKAPLSASMIKRYDEHHQDLTLL</u>

<u>KALVRQQLPEKYKEIFFDQSKNGYAGYIDGGASQEEFYKFIKPILEKMDGTEELLVKL</u>

<u>NREDLLRKQRTFDNGSIPHQIHLGELHAILRRQEDFYPFLKDNREKIEKILTFRIPYYV</u>

<u>GPLARGNSRFAWMTRKSEETITPWNFEEVVDKGASAQSFIERMTNFDKNLPNEKVLP</u>

<u>KHSLLYEYFTVYNELTKVKYVTEGMRKPAFLSGEQKKAIVDLLFKTNRKVTVKQLK</u>

<u>EDYFKKIECFDSVETSGVEDRFNASLGTYHDLLKIIKDKDFLDNEENEDILEDIVLTLTL</u>

<u>FEDREMIEERLKTYAHLFDDKVMKQLKRRRYTGWGRLSRKLINGIRDKQSGKTILDF</u>

<u>LKSDGFANRNFMQLIHDDSLTFKEDIQKAQVSGQGDSLHEHIANLAGSPAIKKGILQT</u>

<u>VKVVDELVKVMGRHKPENIVIEMARENQTTQKGQKNSRERMKRIEEGIKELGSQILK</u>

<u>EHPVENTQLQNEKLYLYYLQNGRDMYVDQELDINRLSDYDVDHIVPQSFLKDDSID</u>

<u>NKVLTRSDKNRGKSDNVPSEEVVKKMKNYWRQLLNAKLITQRKFDNLTKAERGGL</u>

<u>SELDKAGFIKRQLVETRQnKHVAQILDSRMNTKYDENDKLIREVKVITLKSKLVSDF</u>

<u>RKDFQFYKVREINNYHHAHDAYLNAVVGTALIKKYPKLESEFVYGDYKVYDVRKM</u>

<u>IAKSEQEIGKATAKYFFYSNIMNFFKTEITLANGEIRKRPLIETNGETGEIVWDKGRDF</u>

<u>ATVRKVLSMPQVNIVKKTEVQTGGFSKESILPKRNSDKLIARKKDWDPKKYGGFDSP</u>

<u>TVAYSVLVVAKVEKGKSKKLKSVKELLGITIMERSSFEKNPIDFLEAKGYKEVKKDLI</u>

<u>IKLPKYSLFELENGRKRMLASAGELQKGNELALPSKYVNFLYLASHYEKLKGSPEDN</u>

<u>EQKQLFVEQHKHYLDEIIEQISEFSKRVILADANLDKVLSAYNKHRDKPIREQAENIIH</u>

<u>LFTLTNLGAPAAFKYFDTTIDRKRYTSTKEVLDATLIHQSITGLYETRIDLSQLGGDSG</u>

<u>GS</u><u><i>PKKKRKV</i></u> pNMG-623 amino acid sequence: ecTadA<sub>(wild-type)</sub>-32 a.a. linker-ecTadA<sub>(W23L_H36L_P48A_R51L_L84F_A106V_D108N_H123Y_S146C_D147Y_R152P_E155V_I156F_K157N)</sub>-24 a.a. linker_nCas9_GGS_NLS (SEQ ID NO: 706)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD<i>SGGSSGGSSGSETPGTSESATPESSGGSSGGS</i>SEVEFSHEYWMRHALTL

AKRALDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHY

PGMNHRVEITEGILADECAALLCYFFRMPRQVFNAQKKAQSSTD<i>SGGSSGGSSGS</i>

<i>ETPGTSESATPES</i><u>DKKYSIGLAIGTNSVGWAVITDEYKVPSKKFKVLGNTDRHSIKKNL</u>

<u>IGALLFDSGETAEATRLKRTARRRYTRRKNRICYLQEIFSNEMAKVDDSFFHRLEESF</u>

<u>LVEEDKKHERHPIFGNIVDEVAYHEKYPTIYHLRKKLVDSTDKADLRLIYLALAHMI</u>

<u>KFRGHFLIEGDLNPDNSDVDKLFIQLVQTYNQLFEENPINASGVDAKAILSARLSKSR</u>

-continued

RLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLL

KALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNLPNEKVLP

KHSLLYEYFTVYNELTKVKYVTEGMRKPAFLSGEQKKAIVDLLFKTNRKVTVKQLK

EDYFKKIECFDSVETSGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILK

EHPVENTQLQNEKLYLYYLQNGRDMYVDQELDINRLSDYDVDHIVPQSFLKDDSID

NKVLTRSDKNRGKSDNVPSEEVVKKMKNYWRQLLNAKLITQRKFDNLTKAERGGL

SELDKAGFIKRQLVETRQnKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGDSG

GS*PKKKRKV*

In some embodiments, the fusion protein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 11-28, 387, 388, 440, 691-706, or to any of the fusion proteins provided herein. In some embodiments, the fusion protein comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 11-28, 387, 388, 440, 691-706, or any of the fusion proteins provided herein. In some embodiments, the fusion protein comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, at least 170, at least 200, at least 300, at least 400, at least 500, at least 600, at least 700, at least 800, at least 900, at least 1000, at least 1100, at least 1200, at least 1300, at least 1400, at least 1500, at least 1600, at least 1700, at least 1750, or at least 1800 identical contiguous amino acid residues as compared to any one of the amino acid sequences set forth in SEQ ID NOs: 11-28, 387, 388, 440, 691-706, or any of the fusion proteins provided herein.

Nucleic Acid Programmable DNA Binding Protein (napDNAbp) Complexes with Guide Nucleic Acids Some aspects of this disclosure provide complexes comprising any of the fusion proteins provided herein, and a guide nucleic acid bound to napDNAbp of the fusion protein. Some aspects of this disclosure provide complexes comprising any of the fusion proteins provided herein, and a guide RNA bound to a Cas9 domain (e.g., a dCas9, a nuclease active Cas9, or a Cas9 nickase) of fusion protein.

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is an RNA sequence. In some embodiments, the target sequence is a sequence in the genome of a mammal. In some embodiments, the target sequence is a sequence in the genome of a human. In some embodiments, the 3' end of the target sequence is immediately adjacent to a canonical PAM sequence (NGG). In some embodiments, the guide nucleic acid (e.g., guide RNA) is complementary to a sequence associated with a disease or disorder. In some embodiments, the guide nucleic acid (e.g., guide RNA) is complementary to a sequence associated with a disease or disorder having a mutation in a gene selected from the genes disclosed in any one of Tables 1 and 2.

Methods of Using Fusion Proteins Comprising an Adenosine Deaminase and a Nucleic Acid Programmable DNA Binding Protein (napDNAbp) Domain Some aspects of this disclosure provide methods of using the fusion proteins, or complexes comprising a guide nucleic acid (e.g., gRNA) and a nucleobase editor provided herein. For example, some aspects of this disclosure provide methods comprising contacting a DNA, or RNA molecule with any of the fusion proteins provided herein, and with at least one guide nucleic acid (e.g., guide RNA), wherein the guide nucleic acid, (e.g., guide RNA) is about 15-100 nucleotides long and comprises a sequence of at least 10 contiguous nucleotides that is complementary to a target sequence. In some embodiments, the 3' end of the target sequence is acid encoded by the mutant codon. In some embodiments, the deamination of the mutant A results in the codon encoding the wild-type amino acid. In some embodiments, the contacting is in vivo in a subject. In some embodiments, the subject has or has been diagnosed with a disease or disorder. In some embodiments, the disease or disorder is phenylketonuria, von Willebrand disease (vWD), a neoplastic disease associated with a mutant PTEN or BRCA1, or Li-Fraumeni syndrome. A list of exemplary diseases and disorders that may be treated using the nucleobase editors provided herein is shown in Table 1. Table 1 includes the target gene, the mutation to be corrected, the related disease and the nucleotide sequence of the associated protospacer and PAM.

TABLE 1

List of exemplary diseases that may be treated using the nucleobase editors provided herein. The A to be edited in the protospacer is indicated by underlining and the PAM is indicated in bold.

| Target Gene | Mutation | ATCC Cell Line | Disease | Protospater and PAM |
|---|---|---|---|---|
| PTEN | Cys136Tyr | HTB-128 | Cancer Predisposition | TATATGCATATTTATTACATCGG (SEQ ID NO: 85) |
| PTEN | Arg233Ter | HTB-13 | Cancer Predisposition | CCGTCATGTGGGTCCTGAATTGG (SEQ ID NO: 86) |
| TP53 | Glu258Lys | HTB-65 | Cancer Predisposition | ACACTGAAAGACTCCAGGTCAGG (SEQ ID NO: 87) |
| BRCA1 | Gly1738Arg | NA | Cancer Predisposition | GTCAGAAGAGATGTGGTCAATGG (SEQ ID NO: 88) |
| BRCA1 | 4097-1G > A | NA | Cancer Predisposition | TTTAAAGTGAAGCAGCATCTGGG (SEQ ID NO: 89); ATTTAAAGTGAAGCAGCATCTGG (SEQ ID NO: 90) |
| PAH | Thr380Met | NA | Phenylketonuria | ACTCCATGACAGTGTAATTTTGG (SEQ ID NO: 91) |
| VWF | Ser1285Phe | NA | von Willebrand (Hemophilia) | GCCTGGAGAAGCCATCCAGCAGG (SEQ ID NO: 92) |
| VWF | Arg2535Ter | NA | von Willebrand (Hemophilia) | CTCAGACACACTCATTGATGAGG (SEQ ID NO: 93) |
| TP53 | Arg175His | HCC1395 | Li-Fraumeni syndrome | GAGGCACTGCCCCCACCATGAGCG (SEQ ID NO: 94) | immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence.

In some embodiments, the target DNA sequence comprises a sequence associated with a disease or disorder. In some embodiments, the target DNA sequence comprises a point mutation associated with a disease or disorder. In some embodiments, the activity of the fusion protein (e.g., comprising an adenosine deaminase and a Cas9 domain), or the complex, results in a correction of the point mutation. In some embodiments, the target DNA sequence comprises a G→A point mutation associated with a disease or disorder, and wherein the deamination of the mutant A base results in a sequence that is not associated with a disease or disorder. In some embodiments, the target DNA sequence encodes a protein, and the point mutation is in a codon and results in a change in the amino acid encoded by the mutant codon as compared to the wild-type codon. In some embodiments, the deamination of the mutant A results in a change of the amino Some embodiments provide methods for using the DNA editing fusion proteins provided herein. In some embodiments, the fusion protein is used to introduce a point mutation into a nucleic acid by deaminating a target nucleobase, e.g., an A residue. In some embodiments, the deamination of the target nucleobase results in the correction of a genetic defect, e.g., in the correction of a point mutation that leads to a loss of function in a gene product. In some embodiments, the genetic defect is associated with a disease or disorder, e.g., a lysosomal storage disorder or a metabolic disease, such as, for example, type I diabetes. In some embodiments, the methods provided herein are used to introduce a deactivating point mutation into a gene or allele that encodes a gene product that is associated with a disease or disorder. For example, in some embodiments, methods are provided herein that employ a DNA editing fusion protein to introduce a deactivating point mutation into an oncogene (e.g., in the treatment of a proliferative disease). A deactivating mutation may, in some embodiments, generate a premature stop codon in a coding sequence, which results in the expression of a truncated gene product, e.g., a truncated protein lacking the function of the full-length protein.

In some embodiments, the purpose of the methods provided herein is to restore the function of a dysfunctional gene via genome editing. The nucleobase editing proteins provided herein can be validated for gene editing-based human therapeutics in vitro, e.g., by correcting a disease-associated mutation in human cell culture. It will be understood by the skilled artisan that the nucleobase editing proteins provided herein, e.g., the fusion proteins comprising a nucleic acid programmable DNA binding protein (e.g., Cas9) and an adenosine deaminase domain can be used to correct any single point G to A or C to T mutation. In the first case, deamination of the mutant A to I corrects the mutation, and in the latter case, deamination of the A that is base-paired with the mutant T, followed by a round of replication, corrects the mutation. Exemplary point mutations that can be corrected are listed in Tables 1 and 2.

The successful correction of point mutations in disease-associated genes and alleles opens up new strategies for gene correction with applications in therapeutics and basic research. Site-specific single-base modification systems like the disclosed fusions of a nucleic acid programmable DNA binding protein and an adenosine deaminase domain also have applications in "reverse" gene therapy, where certain gene functions are purposely suppressed or abolished. In these cases, site-specifically mutating residues that lead to inactivating mutations in a protein, or mutations that inhibit function of the protein can be used to abolish or inhibit protein function in vitro, ex vivo, or in vivo.

The instant disclosure provides methods for the treatment of a subject diagnosed with a disease associated with or caused by a point mutation that can be corrected by a DNA editing fusion protein provided herein. For example, in some embodiments, a method is provided that comprises administering to a subject having such a disease, e.g., a cancer associated with a point mutation as described above, an effective amount of an adenosine deaminase fusion protein that corrects the point mutation or introduces a deactivating mutation into a disease-associated gene. In some embodiments, the disease is a proliferative disease. In some embodiments, the disease is a genetic disease. In some embodiments, the disease is a neoplastic disease. In some embodiments, the disease is a metabolic disease. In some embodiments, the disease is a lysosomal storage disease. Other diseases that can be treated by correcting a point mutation or introducing a deactivating mutation into a disease-associated gene will be known to those of skill in the art, and the disclosure is not limited in this respect.

The instant disclosure provides methods for the treatment of additional diseases or disorders, e.g., diseases or disorders that are associated or caused by a point mutation that can be corrected by deaminase-mediated gene editing. Some such diseases are described herein, and additional suitable diseases that can be treated with the strategies and fusion proteins provided herein will be apparent to those of skill in the art based on the instant disclosure. Exemplary suitable diseases and disorders are listed below. It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues. Exemplary suitable diseases and disorders include, without limitation: 2-methyl-3-hydroxybutyric aciduria; 3 beta-Hydroxysteroid dehydrogenase deficiency; 3-Methylglutaconic aciduria; 3-Oxo-5 alpha-steroid delta 4-dehydrogenase deficiency; 46,XY sex reversal, type 1, 3, and 5; 5-Oxoprolinase deficiency; 6-pyruvoyl-tetrahydropterin synthase deficiency; Aarskog syndrome; Aase syndrome; Achondrogenesis type 2; Achromatopsia 2 and 7; Acquired long QT syndrome; Acrocallosal syndrome, Schinzel type; Acrocapitofemoral dysplasia; Acrodysostosis 2, with or without hormone resistance; Acroerythrokeratoderma; Acromicric dysplasia; Acth-independent macronodular adrenal hyperplasia 2; Activated PI3K-delta syndrome; Acute intermittent porphyria; deficiency of Acyl-CoA dehydrogenase family, member 9; Adams-Oliver syndrome 5 and 6; Adenine phosphoribosyl-transferase deficiency; Adenylate kinase deficiency; hemolytic anemia due to Adenylosuccinate lyase deficiency; Adolescent nephronophthisis; Renal-hepatic-pancreatic dysplasia; Meckel syndrome type 7; Adrenoleukodystrophy; Adult junctional epidermolysis bullosa; Epidermolysis bullosa, junctional, localisata variant; Adult neuronal ceroid lipofuscinosis; Adult neuronal ceroid lipofuscinosis; Adult onset ataxia with oculomotor apraxia; ADULT syndrome; Afibrinogenemia and congenital Afibrinogenemia; autosomal recessive Agammaglobulinemia 2; Age-related macular degeneration 3, 6, 11, and 12; Aicardi Goutieres syndromes 1, 4, and 5; Chilbain lupus 1; Alagille syndromes 1 and 2; Alexander disease; Alkaptonuria; Allan-Herndon-Dudley syndrome; Alopecia universalis congenital; Alpers encephalopathy; Alpha-1-antitrypsin deficiency; autosomal dominant, autosomal recessive, and X-linked recessive Alport syndromes; Alzheimer disease, familial, 3, with spastic paraparesis and apraxia; Alzheimer disease, types, 1, 3, and 4; hypocalcification type and hypomaturation type, IIA1 Amelogenesis imperfecta; Aminoacylase 1 deficiency; Amish infantile epilepsy syndrome; Amyloidogenic transthyretin amyloidosis; Amyloid Cardiomyopathy, Transthyretin-related; Cardiomyopathy; Amyotrophic lateral sclerosis types 1, 6, 15 (with or without frontotemporal dementia), 22 (with or without frontotemporal dementia), and 10; Frontotemporal dementia with TDP43 inclusions, TAR-DBP-related; Andermann syndrome; Andersen Tawil syndrome; Congenital long QT syndrome; Anemia, nonspherocytic hemolytic, due to G6PD deficiency; Angelman syndrome; Severe neonatal-onset encephalopathy with microcephaly; susceptibility to Autism, X-linked 3; Angiopathy, hereditary, with nephropathy, aneurysms, and muscle cramps; Angiotensin i-converting enzyme, benign serum increase; Aniridia, cerebellar ataxia, and mental retardation; Anonychia; Antithrombin III deficiency; Antley-Bixler syndrome with genital anomalies and disordered steroidogenesis; Aortic aneurysm, familial thoracic 4, 6, and 9; Thoracic aortic aneurysms and aortic dissections; Multisystemic smooth muscle dysfunction syndrome; Moyamoya disease 5; Aplastic anemia; Apparent mineralocorticoid excess; Arginase deficiency; Argininosuccinate lyase deficiency; Aromatase deficiency; Arrhythmogenic right ventricular cardiomyopathy types 5, 8, and 10; Primary familial hypertrophic cardiomyopathy; Arthrogryposis multiplex congenita, distal, X-linked; Arthrogryposis renal dysfunction cholestasis syndrome; Arthrogryposis, renal dysfunction, and cholestasis 2; Asparagine synthetase deficiency; Abnormality of neuronal migration; Ataxia with vitamin E deficiency; Ataxia, sensory, autosomal dominant; Ataxia-telangiectasia syndrome; Hereditary cancer-predisposing syndrome; Atransferrinemia; Atrial fibrillation, familial, 11, 12, 13, and 16; Atrial septal defects 2, 4, and 7 (with or without atrioventricular conduction defects); Atrial standstill 2; Atrioventricular septal defect 4; Atrophia bulborum hereditaria; ATR-X syndrome; Auriculocondylar syndrome 2; Autoimmune disease, multisystem, infantile-onset; Autoimmune lymphoproliferative syndrome, type 1a; Autosomal dominant hypohidrotic ectodermal dysplasia; Autosomal dominant progressive external ophthalmoplegia with mitochondrial DNA deletions 1 and 3; Autosomal dominant torsion dystonia 4; Autosomal recessive centronuclear myopathy; Autosomal recessive congenital ichthyosis 1, 2, 3, 4A, and 4B; Autosomal recessive cutis laxa type IA and 1B; Autosomal recessive hypohidrotic ectodermal dysplasia syndrome; Ectodermal dysplasia 11b; hypohidrotic/hair/tooth type, autosomal recessive; Autosomal recessive hypophosphatemic bone disease; Axenfeld-Rieger syndrome type 3; Bainbridge-Ropers syndrome; Bannayan-Riley-Ruvalcaba syndrome; PTEN hamartoma tumor syndrome; Baraitser-Winter syndromes 1 and 2; Barakat syndrome; Bardet-Biedl syndromes 1, 11, 16, and 19; Bare lymphocyte syndrome type 2, complementation group E; Bartter syndrome antenatal type 2; Bartter syndrome types 3, 3 with hypocalciuria, and 4; Basal ganglia calcification, idiopathic, 4; Beaded hair; Benign familial hematuria; Benign familial neonatal seizures 1 and 2; Seizures, benign familial neonatal, 1, and/or myokymia; Seizures, Early infantile epileptic encephalopathy 7; Benign familial neonatal-infantile seizures; Benign hereditary chorea; Benign scapuloperoneal muscular dystrophy with cardiomyopathy; Bernard-Soulier syndrome, types A1 and A2 (autosomal dominant); Bestrophinopathy, autosomal recessive; beta Thalassemia; Bethlem myopathy and Bethlem myopathy 2; Bietti crystalline corneoretinal dystrophy; Bile acid synthesis defect, congenital, 2; Biotinidase deficiency; Birk Barel mental retardation dysmorphism syndrome; Blepharophimosis, ptosis, and epicanthus inversus; Bloom syndrome; Borjeson-Forssman-Lehmann syndrome; Boucher Neuhauser syndrome; Brachydactyly types A1 and A2; Brachydactyly with hypertension; Brain small vessel disease with hemorrhage; Branched-chain ketoacid dehydrogenase kinase deficiency; Branchiootic syndromes 2 and 3; Breast cancer, early-onset; Breast-ovarian cancer, familial 1, 2, and 4; Brittle cornea syndrome 2; Brody myopathy; Bronchiectasis with or without elevated sweat chloride 3; Brown-Vialetto-Van laere syndrome and Brown-Vialetto-Van Laere syndrome 2; Brugada syndrome; Brugada syndrome 1; Ventricular fibrillation; Paroxysmal familial ventricular fibrillation; Brugada syndrome and Brugada syndrome 4; Long QT syndrome; Sudden cardiac death; Bull eye macular dystrophy; Stargardt disease 4; Cone-rod dystrophy 12; Bullous ichthyosiform erythroderma; Burn-Mckeown syndrome; Candidiasis, familial, 2, 5, 6, and 8; Carbohydrate-deficient glycoprotein syndrome type I and II; Carbonic anhydrase VA deficiency, hyperammonemia due to; Carcinoma of colon; Cardiac arrhythmia; Long QT syndrome, LQT1 subtype; Cardioencephalomyopathy, fatal infantile, due to cytochrome c oxidase deficiency; Cardiofaciocutaneous syndrome; Cardiomyopathy; Danon disease; Hypertrophic cardiomyopathy; Left ventricular noncompaction cardiomyopathy; Carnevale syndrome; Carney complex, type 1; Carnitine acylcarnitine translocase deficiency; Carnitine palmitoyltransferase I, II, II (late onset), and II (infantile) deficiency; Cataract 1, 4, autosomal dominant, autosomal dominant, multiple types, with microcornea, coppock-like, juvenile, with microcornea and glucosuria, and nuclear diffuse nonprogressive; Catecholaminergic polymorphic ventricular tachycardia; Caudal regression syndrome; Cd8 deficiency, familial; Central core disease; Centromeric instability of chromosomes 1, 9 and 16 and immunodeficiency; Cerebellar ataxia infantile with progressive external ophthalmoplegi and Cerebellar ataxia, mental retardation, and dysequilibrium syndrome 2; Cerebral amyloid angiopathy, APP-related; Cerebral autosomal dominant and recessive arteriopathy with subcortical infarcts and leukoencephalopathy; Cerebral cavernous malformations 2; Cerebrooculofacioskeletal syndrome 2; Cerebro-oculo-facio-skeletal syndrome; Cerebroretinal microangiopathy with calcifications and cysts; Ceroid lipofuscinosis neuronal 2, 6, 7, and 10; Ch\xc3\xa9diak-Higashi syndrome, Chediak-Higashi syndrome, adult type; Charcot-Marie-Tooth disease types 1B, 2B2, 2C, 2F, 2I, 2U (axonal), 1C (demyelinating), dominant intermediate C, recessive intermediate A, 2A2, 4C, 4D, 4H, IF, IVF, and X; Scapuloperoneal spinal muscular atrophy; Distal spinal muscular atrophy, congenital nonprogressive; Spinal muscular atrophy, distal, autosomal recessive, 5; CHARGE association; Childhood hypophosphatasia; Adult hypophosphatasia; Cholecystitis; Progressive familial intrahepatic cholestasis 3; Cholestasis, intrahepatic, of pregnancy 3; Cholestanol storage disease; Cholesterol monooxygenase (side-chain cleaving) deficiency; Chondrodysplasia Blomstrand type; Chondrodysplasia punctata 1, X-linked recessive and 2 X-linked dominant; CHOPS syndrome; Chronic granulomatous disease, autosomal recessive cytochrome b-positive, types 1 and 2; Chudley-McCullough syndrome; Ciliary dyskinesia, primary, 7, 11, 15, 20 and 22; Citrullinemia type I; Citrullinemia type I and II; Cleidocranial dysostosis; C-like syndrome; Cockayne syndrome type A; Coenzyme Q10 deficiency, primary 1, 4, and 7; Coffin Siris/Intellectual Disability; Coffin-Lowry syndrome; Cohen syndrome; Cold-induced sweating syndrome 1; COLE-CARPENTER SYNDROME 2; Combined cellular and humoral immune defects with granulomas; Combined d-2- and l-2-hydroxyglutaric aciduria; Combined malonic and methylmalonic aciduria; Combined oxidative phosphorylation deficiencies 1, 3, 4, 12, 15, and 25; Combined partial and complete 17-alpha-hydroxylase/17,20-lyase deficiency; Common variable immunodeficiency 9; Complement component 4, partial deficiency of, due to dysfunctional c1 inhibitor; Complement factor B deficiency; Cone monochromatism; Cone-rod dystrophy 2 and 6; Cone-rod dystrophy amelogenesis imperfecta; Congenital adrenal hyperplasia and Congenital adrenal hypoplasia, X-linked; Congenital amegakaryocytic thrombocytopenia; Congenital aniridia; Congenital central hypoventilation; Hirschsprung disease 3; Congenital contractural arachnodactyly; Congenital contractures of the limbs and face, hypotonia, and developmental delay; Congenital disorder of glycosylation types 1B, 1D, 1G, 1H, 1J, 1K, 1N, 1P, 2C, 2J, 2K, IIm; Congenital dyserythropoietic anemia, type I and II; Congenital ectodermal dysplasia of face; Congenital erythropoietic porphyria; Congenital generalized lipodystrophy type 2; Congenital heart disease, multiple types, 2; Congenital heart disease; Interrupted aortic arch; Congenital lipomatous overgrowth, vascular malformations, and epidermal nevi; Non-small cell lung cancer; Neoplasm of ovary; Cardiac conduction defect, nonspecific; Congenital microvillous atrophy; Congenital muscular dystrophy; Congenital muscular dystrophy due to partial LAMA2 deficiency; Congenital muscular dystrophy-dystroglycanopathy with brain and eye anomalies, types A2, A7, A8, A11, and A14; Congenital muscular dystrophy-dystroglycanopathy with mental retardation, types B2, B3, B5, and B15; Congenital muscular dystrophy-dystroglycanopathy without mental retardation, type B5; Congenital muscular hypertrophy-cerebral syndrome; Congenital myasthenic syndrome, acetazolamide-responsive; Congenital myopathy with fiber type disproportion; Congenital ocular coloboma; Congenital stationary night blindness, type 1A, 1B, 1C, 1E, 1F, and 2A; Coproporphyria; Cornea plana 2; Corneal dystrophy, Fuchs endothelial, 4; Corneal endothelial dystrophy type 2; Corneal fragility keratoglobus, blue sclerae and joint hypermobility; Cornelia de Lange syndromes 1 and 5; Coronary artery disease, autosomal dominant 2; Coronary heart disease; Hyperalphalipoproteinemia 2; Cortical dysplasia, complex, with other brain malformations 5 and 6; Cortical malformations, occipital; Corticosteroid-binding globulin deficiency; Corticosterone methyloxidase type 2 deficiency; Costello syndrome; Cowden syndrome 1; Coxa plana; Craniodiaphyseal dysplasia, autosomal dominant; Craniosynostosis 1 and 4; Craniosynostosis and dental anomalies; Creatine deficiency, X-linked; Crouzon syndrome; Cryptophthalmos syndrome; Cryptorchidism, unilateral or bilateral; Cushing symphalangism; Cutaneous malignant melanoma 1; Cutis laxa with osteodystrophy and with severe pulmonary, gastrointestinal, and urinary abnormalities; Cyanosis, transient neonatal and atypical nephropathic; Cystic fibrosis; Cystinuria; Cytochrome c oxidase i deficiency; Cytochrome-c oxidase deficiency; D-2-hydroxyglutaric aciduria 2; Darier disease, segmental; Deafness with labyrinthine aplasia microtia and microdontia (LAMM); Deafness, autosomal dominant 3a, 4, 12, 13, 15, autosomal dominant nonsyndromic sensorineural 17, 20, and 65; Deafness, autosomal recessive 1A, 2, 3, 6, 8, 9, 12, 15, 16, 18b, 22, 28, 31, 44, 49, 63, 77, 86, and 89; Deafness, cochlear, with myopia and intellectual impairment, without vestibular involvement, autosomal dominant, X-linked 2; Deficiency of 2-methylbutyryl-CoA dehydrogenase; Deficiency of 3-hydroxyacyl-CoA dehydrogenase; Deficiency of alpha-mannosidase; Deficiency of aromatic-L-amino-acid decarboxylase; Deficiency of bisphosphoglycerate mutase; Deficiency of butyryl-CoA dehydrogenase; Deficiency of ferroxidase; Deficiency of galactokinase; Deficiency of guanidinoacetate methyltransferase; Deficiency of hyaluronoglucosaminidase; Deficiency of ribose-5-phosphate isomerase; Deficiency of steroid 11-beta-monooxygenase; Deficiency of UDPglucose-hexose-1-phosphate uridylyltransferase; Deficiency of xanthine oxidase; Dejerine-Sottas disease; Charcot-Marie-Tooth disease, types ID and IVF; Dejerine-Sottas syndrome, autosomal dominant; Dendritic cell, monocyte, B lymphocyte, and natural killer lymphocyte deficiency; Desbuquois dysplasia 2; Desbuquois syndrome; DFNA 2 Nonsyndromic Hearing Loss; Diabetes mellitus and insipidus with optic atrophy and deafness; Diabetes mellitus, type 2, and insulin-dependent, 20; Diamond-Blackfan anemia 1, 5, 8, and 10; Diarrhea 3 (secretory sodium, congenital, syndromic) and 5 (with tufting enteropathy, congenital); Dicarboxylic aminoaciduria; Diffuse palmoplantar keratoderma, Bothnian type; Digitorenocerebral syndrome; Dihydropteridine reductase deficiency; Dilated cardiomyopathy 1A, 1AA, 1C, 1G, 1BB, 1DD, 1FF, 1HH, 1I, 1KK, 1N, 1S, 1Y, and 3B; Left ventricular noncompaction 3; Disordered steroidogenesis due to cytochrome p450 oxidoreductase deficiency; Distal arthrogryposis type 2B; Distal hereditary motor neuronopathy type 2B; Distal myopathy Markesbery-Griggs type; Distal spinal muscular atrophy, X-linked 3; Distichiasis-lymphedema syndrome; Dominant dystrophic epidermolysis bullosa with absence of skin; Dominant hereditary optic atrophy; Donnai Barrow syndrome; Dopamine beta hydroxylase deficiency; Dopamine receptor d2, reduced brain density of; Dowling-degos disease 4; Doyne honeycomb retinal dystrophy; Malattia leventinese; Duane syndrome type 2; Dubin-Johnson syndrome; Duchenne muscular dystrophy; Becker muscular dystrophy; Dysfibrinogenemia; Dyskeratosis congenita autosomal dominant and autosomal dominant, 3; Dyskeratosis congenita, autosomal recessive, 1, 3, 4, and 5; Dyskeratosis congenita X-linked; Dyskinesia, familial, with facial myokymia; Dysplasminogenemia; Dystonia 2 (torsion, autosomal recessive), 3 (torsion, X-linked), 5 (Dopa-responsive type), 10, 12, 16, 25, 26 (Myoclonic); Seizures, benign familial infantile, 2; Early infantile epileptic encephalopathy 2, 4, 7, 9, 10, 11, 13, and 14; Atypical Rett syndrome; Early T cell progenitor acute lymphoblastic leukemia; Ectodermal dysplasia skin fragility syndrome; Ectodermal dysplasia-syndactyly syndrome 1; Ectopia lentis, isolated autosomal recessive and dominant; Ectrodactyly, ectodermal dysplasia, and cleft lip/palate syndrome 3; Ehlers-Danlos syndrome type 7 (autosomal recessive), classic type, type 2 (progeroid), hydroxylysine-deficient, type 4, type 4 variant, and due to tenascin-X deficiency; Eichsfeld type congenital muscular dystrophy; Endocrine-cerebroosteodysplasia; Enhanced s-cone syndrome; Enlarged vestibular aqueduct syndrome; Enterokinase deficiency; Epidermodysplasia verruciformis; Epidermolysa bullosa simplex and limb girdle muscular dystrophy, simplex with mottled pigmentation, simplex with pyloric atresia, simplex, autosomal recessive, and with pyloric atresia; Epidermolytic palmoplantar keratoderma; Familial febrile seizures 8; Epilepsy, childhood absence 2, 12 (idiopathic generalized, susceptibility to) 5 (nocturnal frontal lobe), nocturnal frontal lobe type 1, partial, with variable foci, progressive myoclonic 3, and X-linked, with variable learning disabilities and behavior disorders; Epileptic encephalopathy, childhood-onset, early infantile, 1, 19, 23, 25, 30, and 32; Epiphyseal dysplasia, multiple, with myopia and conductive deafness; Episodic ataxia type 2; Episodic pain syndrome, familial, 3; Epstein syndrome; Fechtner syndrome; Erythropoietic protoporphyria; Estrogen resistance; Exudative vitreoretinopathy 6; Fabry disease and Fabry disease, cardiac variant; Factor H, VII, X, v and factor viii, combined deficiency of 2, xiii, a subunit, deficiency; Familial adenomatous polyposis 1 and 3; Familial amyloid nephropathy with urticaria and deafness; Familial cold urticarial; Familial aplasia of the vermis; Familial benign pemphigus; Familial cancer of breast; Breast cancer, susceptibility to; Osteosarcoma; Pancreatic cancer 3; Familial cardiomyopathy; Familial cold autoinflammatory syndrome 2; Familial colorectal cancer; Familial exudative vitreoretinopathy, X-linked; Familial hemiplegic migraine types 1 and 2; Familial hypercholesterolemia; Familial hypertrophic cardiomyopathy 1, 2, 3, 4, 7, 10, 23 and 24; Familial hypokalemia-hypomagnesemia; Familial hypoplastic, glomerulocystic kidney; Familial infantile myasthenia; Familial juvenile gout; Familial Mediterranean fever and Familial mediterranean fever, autosomal dominant; Familial porencephaly; Familial porphyria cutanea tarda; Familial pulmonary capillary hemangiomatosis; Familial renal glucosuria; Familial renal hypouricemia; Familial restrictive cardiomyopathy 1; Familial type 1 and 3 hyperlipoproteinemia; Fanconi anemia, complementation group E, I, N, and O; Fanconi-Bickel syndrome; Favism, susceptibility to; Febrile seizures, familial, 11; Feingold syndrome 1; Fetal hemoglobin quantitative trait locus 1; FG syndrome and FG syndrome 4; Fibrosis of extraocular muscles, congenital, 1, 2, 3a (with or without extraocular involvement), 3b; Fish-eye disease; Fleck corneal dystrophy; Floating-Harbor syndrome; Focal epilepsy with speech disorder with or without mental retardation; Focal segmental glomerulosclerosis 5; Forebrain defects; Frank Ter Haar syndrome; Borrone Di Rocco Crovato syndrome; Frasier syndrome; Wilms tumor 1; Freeman-Sheldon syndrome; Frontometaphyseal dysplasia Iand 3; Frontotemporal dementia; Frontotemporal dementia and/or amyotrophic lateral sclerosis 3 and 4; Frontotemporal Dementia Chromosome 3-Linked and Frontotemporal dementia ubiquitin-positive; Fructose-biphosphatase deficiency; Fuhrmann syndrome; Gamma-aminobutyric acid transaminase deficiency; Gamstorp-Wohlfart syndrome; Gaucher disease type 1 and Subacute neuronopathic; Gaze palsy, familial horizontal, with progressive scoliosis; Generalized dominant dystrophic epidermolysis bullosa; Generalized epilepsy with febrile seizures plus 3, type 1, type 2; Epileptic encephalopathy Lennox-Gastaut type; Giant axonal neuropathy; Glanzmann thrombasthenia; Glaucoma 1, open angle, e, F, and G; Glaucoma 3, primary congenital, d; Glaucoma, congenital and Glaucoma, congenital, Coloboma; Glaucoma, primary open angle, juvenile-onset; Glioma susceptibility 1; Glucose transporter type 1 deficiency syndrome; Glucose-6-phosphate transport defect; GLUT1 deficiency syndrome 2; Epilepsy, idiopathic generalized, susceptibility to, 12; Glutamate formiminotransferase deficiency; Glutaric acidemia IIA and IIB; Glutaric aciduria, type 1; Glutathione synthetase deficiency; Glycogen storage disease 0 (muscle), II (adult form), IXa2, IXc, type 1A; type II, type IV, IV (combined hepatic and myopathic), type V, and type VI; Goldmann-Favre syndrome; Gordon syndrome; Gorlin syndrome; Holoprosencephaly sequence; Holoprosencephaly 7; Granulomatous disease, chronic, X-linked, variant; Granulosa cell tumor of the ovary; Gray platelet syndrome; Griscelli syndrome type 3; Groenouw corneal dystrophy type I; Growth and mental retardation, mandibulofacial dysostosis, microcephaly, and cleft palate; Growth hormone deficiency with pituitary anomalies; Growth hormone insensitivity with immunodeficiency; GTP cyclohydrolase I deficiency; Hajdu-Cheney syndrome; Hand foot uterus syndrome; Hearing impairment; Hemangioma, capillary infantile; Hematologic neoplasm; Hemochromatosis type 1, 2B, and 3; Microvascular complications of diabetes 7; Transferrin serum level quantitative trait locus 2; Hemoglobin H disease, nondeletional; Hemolytic anemia, nonspherocytic, due to glucose phosphate isomerase deficiency; Hemophagocytic lymphohistiocytosis, familial, 2; Hemophagocytic lymphohistiocytosis, familial, 3; Heparin cofactor II deficiency; Hereditary acrodermatitis enteropathica; Hereditary breast and ovarian cancer syndrome; Ataxia-telangiectasia-like disorder; Hereditary diffuse gastric cancer; Hereditary diffuse leukoencephalopathy with spheroids; Hereditary factors II, IX, VIII deficiency disease; Hereditary hemorrhagic telangiectasia type 2; Hereditary insensitivity to pain with anhidrosis; Hereditary lymphedema type I; Hereditary motor and sensory neuropathy with optic atrophy; Hereditary myopathy with early respiratory failure; Hereditary neuralgic amyotrophy; Hereditary Nonpolyposis Colorectal Neoplasms; Lynch syndrome I and II; Hereditary pancreatitis; Pancreatitis, chronic, susceptibility to; Hereditary sensory and autonomic neuropathy type IIB amd IIA; Hereditary sideroblastic anemia; Hermansky-Pudlak syndrome 1, 3, 4, and 6; Heterotaxy, visceral, 2, 4, and 6, autosomal; Heterotaxy, visceral, X-linked; Heterotopia; Histiocytic medullary reticulosis; Histiocytosis-lymphadenopathy plus syndrome; Holocarboxylase synthetase deficiency; Holoprosencephaly 2, 3, 7, and 9; Holt-Oram syndrome; Homocysteinemia due to MTHFR deficiency, CBS deficiency, and Homocystinuria, pyridoxine-responsive; Homocystinuria-Megaloblastic anemia due to defect in cobalamin metabolism, cblE complementation type; Howel-Evans syndrome; Hurler syndrome; Hutchinson-Gilford syndrome; Hydrocephalus; Hyperammonemia, type III; Hypercholesterolaemia and Hypercholesterolemia, autosomal recessive; Hyperekplexia 2 and Hyperekplexia hereditary; Hyperferritinemia cataract syndrome; Hyperglycinuria; Hyperimmunoglobulin D with periodic fever; Mevalonic aciduria; Hyperimmunoglobulin E syndrome; Hyperinsulinemic hypoglycemia familial 3, 4, and 5; Hyperinsulinism-hyperammonemia syndrome; Hyperlysinemia; Hypermanganesemia with dystonia, polycythemia and cirrhosis; Hyperornithinemia-hyperammonemia-homocitrullinuria syndrome; Hyperparathyroidism 1 and 2; Hyperparathyroidism, neonatal severe; Hyperphenylalaninemia, bh4-deficient, a, due to partial pts deficiency, BH4-deficient, D, and non-pku; Hyperphosphatasia with mental retardation syndrome 2, 3, and 4; Hypertrichotic osteochondrodysplasia; Hypobetalipoproteinemia, familial, associated with apob32; Hypocalcemia, autosomal dominant 1; Hypocalciuric hypercalcemia, familial, types 1 and 3; Hypochondrogenesis; Hypochromic microcytic anemia with iron overload; Hypoglycemia with deficiency of glycogen synthetase in the liver; Hypogonadotropic hypogonadism 11 with or without anosmia; Hypohidrotic ectodermal dysplasia with immune deficiency; Hypohidrotic X-linked ectodermal dysplasia; Hypokalemic periodic paralysis 1 and 2; Hypomagnesemia 1, intestinal; Hypomagnesemia, seizures, and mental retardation; Hypomyelinating leukodystrophy 7; Hypoplastic left heart syndrome; Atrioventricular septal defect and common atrioventricular junction; Hypospadias 1 and 2, X-linked; Hypothyroidism, congenital, nongoitrous, 1; Hypotrichosis 8 and 12; Hypotrichosis-lymphedema-telangiectasia syndrome; I blood group system; Ichthyosis bullosa of Siemens; Ichthyosis exfoliativa; Ichthyosis prematurity syndrome; Idiopathic basal ganglia calcification 5; Idiopathic fibrosing alveolitis, chronic form; Dyskeratosis congenita, autosomal dominant, 2 and 5; Idiopathic hypercalcemia of infancy; Immune dysfunction with T-cell inactivation due to calcium entry defect 2; Immunodeficiency 15, 16, 19, 30, 31C, 38, 40, 8, due to defect in cd3-zeta, with hyper IgM type 1 and 2, and X-Linked, with magnesium defect, Epstein-Barr virus infection, and neoplasia; Immunodeficiency-centromeric instability-facial anomalies syndrome 2; Inclusion body myopathy 2 and 3; Nonaka myopathy; Infantile convulsions and paroxysmal choreoathetosis, familial; Infantile cortical hyperostosis; Infantile GM1 gangliosidosis; Infantile hypophosphatasia; Infantile nephronophthisis; Infantile nystagmus, X-linked; Infantile Parkinsonism-dystonia; Infertility associated with multi-tailed spermatozoa and excessive DNA; Insulin resistance; Insulin-resistant diabetes mellitus and acanthosis nigricans; Insulin-dependent diabetes mellitus secretory diarrhea syndrome; Interstitial nephritis, karyomegalic; Intrauterine growth retardation, metaphyseal dysplasia, adrenal hypoplasia congenita, and genital anomalies; lodotyrosyl coupling defect; IRAK4 deficiency; Iridogoniodysgenesis dominant type and type 1; Iron accumulation in brain; Ischiopatellar dysplasia; Islet cell hyperplasia; Isolated 17,20-lyase deficiency; Isolated lutropin deficiency; Isovaleryl-CoA dehydrogenase deficiency; Jankovic Rivera syndrome; Jervell and Lange-Nielsen syndrome 2; Joubert syndrome 1, 6, 7, 9/15 (digenic), 14, 16, and 17, and Orofaciodigital syndrome xiv; Junctional epidermolysis bullosa gravis of Herlitz; Juvenile GM>1<gangliosidosis; Juvenile polyposis syndrome; Juvenile polyposis/hereditary hemorrhagic telangiectasia syndrome; Juvenile retinoschisis; Kabuki make-up syndrome; Kallmann syndrome 1, 2, and 6; Delayed puberty; Kanzaki disease; Karak syndrome; Kartagener syndrome; Kenny-Caffey syndrome type 2; Keppen-Lubinsky syndrome; Keratoconus 1; Keratosis follicularis; Keratosis palmoplantaris striata 1; Kindler syndrome; L-2-hydroxyglutaric aciduria; Larsen syndrome, dominant type; Lattice corneal dystrophy Type III; Leber amaurosis; Zellweger syndrome; Peroxisome biogenesis disorders; Zellweger syndrome spectrum; Leber congenital amaurosis 11, 12, 13, 16, 4, 7, and 9; Leber optic atrophy; Aminoglycoside-induced deafness; Deafness, nonsyndromic sensorineural, mitochondrial; Left ventricular noncompaction 5; Left-right axis malformations; Leigh disease; Mitochondrial short-chain Enoyl-CoA Hydratase 1 deficiency; Leigh syndrome due to mitochondrial complex I deficiency; Leiner disease; Leri Weill dyschondrosteosis; Lethal congenital contracture syndrome 6; Leukocyte adhesion deficiency type I and III; Leukodystrophy, Hypomyelinating, 11 and 6; Leukoencephalopathy with ataxia, with Brainstem and Spinal Cord Involvement and Lactate Elevation, with vanishing white matter, and progressive, with ovarian failure; Leukonychia totalis; Lewy body dementia; Lichtenstein-Knorr Syndrome; Li-Fraumeni syndrome 1; Lig4 syndrome; Limb-girdle muscular dystrophy, type 1B, 2A, 2B, 2D, C1, C5, C9, C14; Congenital muscular dystrophy-dystroglycanopathy with brain and eye anomalies, type A14 and B14; Lipase deficiency combined; Lipid proteinosis; Lipodystrophy, familial partial, type 2 and 3; Lissencephaly 1, 2 (X-linked), 3, 6 (with microcephaly), X-linked; Subcortical laminar heterotopia, X-linked; Liver failure acute infantile; Loeys-Dietz syndrome 1, 2, 3; Long QT syndrome 1, 2, 2/9, 2/5, (digenic), 3, 5 and 5, acquired, susceptibility to; Lung cancer; Lymphedema, hereditary, id; Lymphedema, primary, with myelodysplasia; Lymphoproliferative syndrome 1, 1 (X-linked), and 2; Lysosomal acid lipase deficiency; Macrocephaly, macrosomia, facial dysmorphism syndrome; Macular dystrophy, vitelliform, adult-onset; Malignant hyperthermia susceptibility type 1; Malignant lymphoma, non-Hodgkin; Malignant melanoma; Malignant tumor of prostate; Mandibuloacral dysostosis; Mandibuloacral dysplasia with type A or B lipodystrophy, atypical; Mandibulofacial dysostosis, Treacher Collins type, autosomal recessive; Mannose-binding protein deficiency; Maple syrup urine disease type 1A and type 3; Marden Walker like syndrome; Marfan syndrome; Marinesco-Sj\xc3\xb6gren syndrome; Martsolf syndrome; Maturity-onset diabetes of the young, type 1, type 2, type 11, type 3, and type 9; May-Hegglin anomaly; MYH9 related disorders; Sebastian syndrome; McCune-Albright syndrome; Somatotroph adenoma; Sex cord-stromal tumor; Cushing syndrome; McKusick Kaufman syndrome; McLeod neuroacanthocytosis syndrome; Meckel-Gruber syndrome; Medium-chain acyl-coenzyme A dehydrogenase deficiency; Medulloblastoma; Megalencephalic leukoencephalopathy with subcortical cysts 1and 2a; Megalencephaly cutis marmorata telangiectatica congenita; PIK3CA Related Overgrowth Spectrum; Megalencephaly-polymicrogyria-polydactyly-hydrocephalus syndrome 2; Megaloblastic anemia, thiamine-responsive, with diabetes mellitus and sensorineural deafness; Meier-Gorlin syndromes 1and 4; Melnick-Needles syndrome; Meningioma; Mental retardation, X-linked, 3, 21, 30, and 72; Mental retardation and microcephaly with pontine and cerebellar hypoplasia; Mental retardation X-linked syndromic 5; Mental retardation, anterior maxillary protrusion, and strabismus; Mental retardation, autosomal dominant 12, 13, 15, 24, 3, 30, 4, 5, 6, and 9; Mental retardation, autosomal recessive 15, 44, 46, and 5; Mental retardation, stereotypic movements, epilepsy, and/or cerebral malformations; Mental retardation, syndromic, Claes-Jensen type, X-linked; Mental retardation, X-linked, nonspecific, syndromic, Hedera type, and syndromic, wu type; Merosin deficient congenital muscular dystrophy; Metachromatic leukodystrophy juvenile, late infantile, and adult types; Metachromatic leukodystrophy; Metatrophic dysplasia; Methemoglobinemia types I and 2; Methionine adenosyltransferase deficiency, autosomal dominant; Methylmalonic acidemia with homocystinuria; Methylmalonic aciduria cblB type; Methylmalonic aciduria due to methylmalonyl-CoA mutase deficiency; METHYLMALONIC ACIDURIA, mut(0) TYPE; Microcephalic osteodysplastic primordial dwarfism type 2; Microcephaly with or without chorioretinopathy, lymphedema, or mental retardation; Microcephaly, hiatal hernia and nephrotic syndrome; Microcephaly; Hypoplasia of the corpus callosum; Spastic paraplegia 50, autosomal recessive; Global developmental delay; CNS hypomyelination; Brain atrophy; Microcephaly, normal intelligence and immunodeficiency; Microcephaly-capillary malformation syndrome; Microcytic anemia; Microphthalmia syndromic 5, 7, and 9; Microphthalmia, isolated 3, 5, 6, 8, and with coloboma 6; Microspherophakia; Migraine, familial basilar; Miller syndrome; Minicore myopathy with external ophthalmoplegia; Myopathy, congenital with cores; Mitchell-Riley syndrome; mitochondrial 3-hydroxy-3-methylglutaryl-CoA synthase deficiency; Mitochondrial complex I, II, III, III (nuclear type 2, 4, or 8) deficiency; Mitochondrial DNA depletion syndrome 11, 12 (cardiomyopathic type), 2, 4B (MNGIE type), 8B (MNGIE type); Mitochondrial DNA-depletion syndrome 3 and 7, hepatocerebral types, and 13 (encephalomyopathic type); Mitochondrial phosphate carrier and pyruvate carrier deficiency; Mitochondrial trifunctional protein deficiency; Long-chain 3-hydroxyacyl-CoA dehydrogenase deficiency; Miyoshi muscular dystrophy 1; Myopathy, distal, with anterior tibial onset; Mohr-Tranebjaerg syndrome; Molybdenum cofactor deficiency, complementation group A; Mowat-Wilson syndrome; Mucolipidosis III Gamma; Mucopolysaccharidosis type VI, type VI (severe), and type VII; Mucopolysaccharidosis, MPS-I-H/S, MPS-II, MPS-III-A, MPS-III-B, MPS-III-C, MPS-IV-A, MPS-IV-B; Retinitis Pigmentosa 73; Gangliosidosis GM1 type1 (with cardiac involvement) 3; Multicentric osteolysis nephropathy; Multicentric osteolysis, nodulosis and arthropathy; Multiple congenital anomalies; Atrial septal defect 2; Multiple congenital anomalies-hypotonia-seizures syndrome 3; Multiple Cutaneous and Mucosal Venous Malformations; Multiple endocrine neoplasia, types 1and 4; Multiple epiphyseal dysplasia 5 or Dominant; Multiple gastrointestinal atresias; Multiple pterygium syndrome Escobar type; Multiple sulfatase deficiency; Multiple synostoses syndrome 3; Muscle AMP deaminase deficiency; Muscle eye brain disease; Muscular dystrophy, congenital, megaconial type; Myasthenia, familial infantile, 1; Myasthenic Syndrome, Congenital, 11, associated with acetylcholine receptor deficiency; Myasthenic Syndrome, Congenital, 17, 2A (slow-channel), 4B (fast-channel), and without tubular aggregates; Myeloperoxidase deficiency; MYH-associated polyposis; Endometrial carcinoma; Myocardial infarction 1; Myoclonic dystonia; Myoclonic-Atonic Epilepsy; Myoclonus with epilepsy with ragged red fibers; Myofibrillar myopathy 1 and ZASP-related; Myoglobinuria, acute recurrent, autosomal recessive; Myoneural gastrointestinal encephalopathy syndrome; Cerebellar ataxia infantile with progressive external ophthalmoplegia; Mitochondrial DNA depletion syndrome 4B, MNGIE type; Myopathy, centronuclear, 1, congenital, with excess of muscle spindles, distal, 1, lactic acidosis, and sideroblastic anemia 1, mitochondrial progressive with congenital cataract, hearing loss, and developmental delay, and tubular aggregate, 2; Myopia 6; Myosclerosis, autosomal recessive; Myotonia congenital; Congenital myotonia, autosomal dominant and recessive forms; Nail-patella syndrome; Nance-Horan syndrome; Nanophthalmos 2; Navajo neurohepatopathy; Nemaline myopathy 3 and 9; Neonatal hypotonia; Intellectual disability; Seizures; Delayed speech and language development; Mental retardation, autosomal dominant 31; Neonatal intrahepatic cholestasis caused by citrin deficiency; Nephrogenic diabetes insipidus, Nephrogenic diabetes insipidus, X-linked; Nephrolithiasis/osteoporosis, hypophosphatemic, 2; Nephronophthisis 13, 15 and 4; Infertility; Cerebello-oculo-renal syndrome (nephronophthisis, oculomotor apraxia and cerebellar abnormalities); Nephrotic syndrome, type 3, type 5, with or without ocular abnormalities, type 7, and type 9; Nestor-Guillermo progeria syndrome; Neu-Laxova syndrome 1; Neurodegeneration with brain iron accumulation 4 and 6; Neuroferritinopathy; Neurofibromatosis, type l and type 2; Neurofibrosarcoma; Neurohypophyseal diabetes insipidus; Neuropathy, Hereditary Sensory, Type IC; Neutral 1 amino acid transport defect; Neutral lipid storage disease with myopathy; Neutrophil immunodeficiency syndrome; Nicolaides-Baraitser syndrome; Niemann-Pick disease type C1, C2, type A, and type C1, adult form; Non-ketotic hyperglycinemia; Noonan syndrome 1 and 4, LEOPARD syndrome 1; Noonan syndrome-like disorder with or without juvenile myelomonocytic leukemia; Normokalemic periodic paralysis, potassium-sensitive; Norum disease; Epilepsy, Hearing Loss, And Mental Retardation Syndrome; Mental Retardation, X-Linked 102 and syndromic 13; Obesity; Ocular albinism, type I; Oculocutaneous albinism type 1B, type 3, and type 4; Oculodentodigital dysplasia; Odontohypophosphatasia; Odontotrichomelic syndrome; Oguchi disease; Oligodontia-colorectal cancer syndrome; Opitz G/BBB syndrome; Optic atrophy 9; Oral-facial-digital syndrome; Ornithine aminotransferase deficiency; Orofacial cleft 11 and 7, Cleft lip/palate-ectodermal dysplasia syndrome; Orstavik Lindemann Solberg syndrome; Osteoarthritis with mild chondrodysplasia; Osteochondritis dissecans; Osteogenesis imperfecta type 12, type 5, type 7, type 8, type I, type III, with normal sclerae, dominant form, recessive perinatal lethal; Osteopathia striata with cranial sclerosis; Osteopetrosis autosomal dominant type 1 and 2, recessive 4, recessive 1, recessive 6; Osteoporosis with pseudoglioma; Oto-palato-digital syndrome, types I and II; Ovarian dysgenesis 1; Ovarioleukodystrophy; Pachyonychia congenita 4 and type 2; Paget disease of bone, familial; Pallister-Hall syndrome; Palmoplantar keratoderma, nonepidermolytic, focal or diffuse; Pancreatic agenesis and congenital heart disease; Papillon-Lef\xc3\xa8vre syndrome; Paragangliomas 3; Paramyotonia congenita of von Eulenburg; Parathyroid carcinoma; Parkinson disease 14, 15, 19 (juvenile-onset), 2, 20 (early-onset), 6, (autosomal recessive early-onset, and 9; Partial albinism; Partial hypoxanthine-guanine phosphoribosyltransferase deficiency; Patterned dystrophy of retinal pigment epithelium; PC-K6a; Pelizaeus-Merzbacher disease; Pendred syndrome; Peripheral demyelinating neuropathy, central dysmyelination; Hirschsprung disease; Permanent neonatal diabetes mellitus; Diabetes mellitus, permanent neonatal, with neurologic features; Neonatal insulin-dependent diabetes mellitus; Maturity-onset diabetes of the young, type 2; Peroxisome biogenesis disorder 14B, 2A, 4A, 5B, 6A, 7A, and 7B; Perrault syndrome 4; Perry syndrome; Persistent hyperinsulinemic hypoglycemia of infancy; familial hyperinsulinism; Phenotypes; Phenylketonuria; Pheochromocytoma; Hereditary Paraganglioma-Pheochromocytoma Syndromes; Paragangliomas 1; Carcinoid tumor of intestine; Cowden syndrome 3; Phosphoglycerate dehydrogenase deficiency; Phosphoglycerate kinase 1 deficiency; Photosensitive trichothiodystrophy; Phytanic acid storage disease; Pick disease; Pierson syndrome; Pigmentary retinal dystrophy; Pigmented nodular adrenocortical disease, primary, 1; Pilomatrixoma; Pitt-Hopkins syndrome; Pituitary dependent hypercortisolism; Pituitary hormone deficiency, combined 1, 2, 3, and 4; Plasminogen activator inhibitor type 1 deficiency; Plasminogen deficiency, type I; Platelet-type bleeding disorder 15 and 8; Poikiloderma, hereditary fibrosing, with tendon contractures, myopathy, and pulmonary fibrosis; Polycystic kidney disease 2, adult type, and infantile type; Polycystic lipomembranous osteodysplasia with sclerosing leukoencephalopathy; Polyglucosan body myopathy 1 with or without immunodeficiency; Polymicrogyria, asymmetric, bilateral frontoparietal; Polyneuropathy, hearing loss, ataxia, retinitis pigmentosa, and cataract; Pontocerebellar hypoplasia type 4; Popliteal pterygium syndrome; Porencephaly 2; Porokeratosis 8, disseminated superficial actinic type; Porphobilinogen synthase deficiency; Porphyria cutanea tarda; Posterior column ataxia with retinitis pigmentosa; Posterior polar cataract type 2; Prader-Willi-like syndrome; Premature ovarian failure 4, 5, 7, and 9; Primary autosomal recessive microcephaly 10, 2, 3, and 5; Primary ciliary dyskinesia 24; Primary dilated cardiomyopathy; Left ventricular noncompaction 6; 4, Left ventricular noncompaction 10; Paroxysmal atrial fibrillation; Primary hyperoxaluria, type I, type, and type III; Primary hypertrophic osteoarthropathy, autosomal recessive 2; Primary hypomagnesemia; Primary open angle glaucoma juvenile onset 1; Primary pulmonary hypertension; Primrose syndrome; Progressive familial heart block type 1B; Progressive familial intrahepatic cholestasis 2 and 3; Progressive intrahepatic cholestasis; Progressive myoclonus epilepsy with ataxia; Progressive pseudorheumatoid dysplasia; Progressive sclerosing poliodystrophy; Prolidase deficiency; Proline dehydrogenase deficiency; Schizophrenia 4; Properdin deficiency, X-linked; Propionic academia; Proprotein convertase 1/3 deficiency; Prostate cancer, hereditary, 2; Protan defect; Proteinuria; Finnish congenital nephrotic syndrome; Proteus syndrome; Breast adenocarcinoma; Pseudoachondroplastic spondyloepiphyseal dysplasia syndrome; Pseudohypoaldosteronism type 1 autosomal dominant and recessive and type 2; Pseudohypoparathyroidism type 1A, Pseudopseudohypoparathyroidism; Pseudoneonatal adrenoleukodystrophy; Pseudoprimary hyperaldosteronism; Pseudoxanthoma elasticum; Generalized arterial calcification of infancy 2; Pseudoxanthoma elasticum-like disorder with multiple coagulation factor deficiency; Psoriasis susceptibility 2; PTEN hamartoma tumor syndrome; Pulmonary arterial hypertension related to hereditary hemorrhagic telangiectasia; Pulmonary Fibrosis And/Or Bone Marrow Failure, Telomere-Related, 1 and 3; Pulmonary hypertension, primary, 1, with hereditary hemorrhagic telangiectasia; Purine-nucleoside phosphorylase deficiency; Pyruvate carboxylase deficiency; Pyruvate dehydrogenase E1-alpha deficiency; Pyruvate kinase deficiency of red cells; Raine syndrome; Rasopathy; Recessive dystrophic epidermolysis bullosa; Nail disorder, nonsyndromic congenital, 8; Reifenstein syndrome; Renal adysplasia; Renal carnitine transport defect; Renal coloboma syndrome; Renal dysplasia; Renal dysplasia, retinal pigmentary dystrophy, cerebellar ataxia and skeletal dysplasia; Renal tubular acidosis, distal, autosomal recessive, with late-onset sensorineural hearing loss, or with hemolytic anemia; Renal tubular acidosis, proximal, with ocular abnormalities and mental retardation; Retinal cone dystrophy 3B; Retinitis pigmentosa; Retinitis pigmentosa 10, 11, 12, 14, 15, 17, and 19; Retinitis pigmentosa 2, 20, 25, 35, 36, 38, 39, 4, 40, 43, 45, 48, 66, 7, 70, 72; Retinoblastoma; Rett disorder; Rhabdoid tumor predisposition syndrome 2; Rhegmatogenous retinal detachment, autosomal dominant; Rhizomelic chondrodysplasia punctata type 2 and type 3; Roberts-SC phocomelia syndrome; Robinow Sorauf syndrome; Robinow syndrome, autosomal recessive, autosomal recessive, with brachy-syn-polydactyly; Rothmund-Thomson syndrome; Rapadilino syndrome; RRM2B-related mitochondrial disease; Rubinstein-Taybi syndrome; Salla disease; Sandhoff disease, adult and infantile types; Sarcoidosis, early-onset; Blau syndrome; Schindler disease, type 1; Schizencephaly; Schizophrenia 15; Schneckenbecken dysplasia; Schwannomatosis 2; Schwartz Jampel syndrome type 1; Sclerocornea, autosomal recessive; Sclerosteosis; Secondary hypothyroidism; Segawa syndrome, autosomal recessive; Senior-Loken syndrome 4 and 5; Sensory ataxic neuropathy, dysarthria, and ophthalmoparesis; Sepiapterin reductase deficiency; SeSAME syndrome; Severe combined immunodeficiency due to ADA deficiency, with microcephaly, growth retardation, and sensitivity to ionizing radiation, atypical, autosomal recessive, T cell-negative, B cell-positive, NK cell-negative of NK-positive; Partial adenosine deaminase deficiency; Severe congenital neutropenia; Severe congenital neutropenia 3, autosomal recessive or dominant; Severe congenital neutropenia and 6, autosomal recessive; Severe myoclonic epilepsy in infancy; Generalized epilepsy with febrile seizures plus, types 1 and 2; Severe X-linked myotubular myopathy; Short QT syndrome 3; Short stature with nonspecific skeletal abnormalities; Short stature, auditory canal atresia, mandibular hypoplasia, skeletal abnormalities; Short stature, onychodysplasia, facial dysmorphism, and hypotrichosis; Primordial dwarfism; Short-rib thoracic dysplasia 11 or 3 with or without polydactyly; Sialidosis type I and II; Silver spastic paraplegia syndrome; Slowed nerve conduction velocity, autosomal dominant; Smith-Lemli-Opitz syndrome; Snyder Robinson syndrome; Somatotroph adenoma; Prolactinoma; familial, Pituitary adenoma predisposition; Sotos syndrome 1 or 2; Spastic ataxia 5, autosomal recessive, Charlevoix-Saguenay type, 1, 10, or 11, autosomal recessive; Amyotrophic lateral sclerosis type 5; Spastic paraplegia 15, 2, 3, 35, 39, 4, autosomal dominant, 55, autosomal recessive, and 5A; Bile acid synthesis defect, congenital, 3; Spermatogenic failure 11, 3, and 8; Spherocytosis types 4 and 5; Spheroid body myopathy; Spinal muscular atrophy, lower extremity predominant 2, autosomal dominant; Spinal muscular atrophy, type II; Spinocerebellar ataxia 14, 21, 35, 40, and 6; Spinocerebellar ataxia autosomal recessive 1 and 16; Splenic hypoplasia; Spondylocarpotarsal synostosis syndrome; Spondylocheirodysplasia, Ehlers-Danlos syndrome-like, with immune dysregulation, Aggrecan type, with congenital joint dislocations, short limb-hand type, Sedaghatian type, with cone-rod dystrophy, and Kozlowski type; Parastremmatic dwarfism; Stargardt disease 1; Cone-rod dystrophy 3; Stickler syndrome type 1; Kniest dysplasia; Stickler syndrome, types 1 (nonsyndromic ocular) and 4; Sting-associated vasculopathy, infantile-onset; Stormorken syndrome; Sturge-Weber syndrome, Capillary malformations, congenital, 1; Succinyl-CoA acetoacetate transferase deficiency; Sucrase-isomaltase deficiency; Sudden infant death syndrome; Sulfite oxidase deficiency, isolated; Supravalvar aortic stenosis; Surfactant metabolism dysfunction, pulmonary, 2 and 3; Symphalangism, proximal, 1b; Syndactyly Cenani Lenz type; Syndactyly type 3; Syndromic X-linked mental retardation 16; Talipes equinovarus; Tangier disease; TARP syndrome; Tay-Sachs disease, B1 variant, Gm2-gangliosidosis (adult), Gm2-gangliosidosis (adult-onset); Temtamy syndrome; Tenorio Syndrome; Terminal osseous dysplasia; Testosterone 17-beta-dehydrogenase deficiency; Tetraamelia, autosomal recessive; Tetralogy of Fallot; Hypoplastic left heart syndrome 2; Truncus arteriosus; Malformation of the heart and great vessels; Ventricular septal defect 1; Thiel-Behnke corneal dystrophy; Thoracic aortic aneurysms and aortic dissections; Marfanoid habitus; Three M syndrome 2; Thrombocytopenia, platelet dysfunction, hemolysis, and imbalanced globin synthesis; Thrombocytopenia, X-linked; Thrombophilia, hereditary, due to protein C deficiency, autosomal dominant and recessive; Thyroid agenesis; Thyroid cancer, follicular; Thyroid hormone metabolism, abnormal; Thyroid hormone resistance, generalized, autosomal dominant; Thyrotoxic periodic paralysis and Thyrotoxic periodic paralysis 2; Thyrotropin-releasing hormone resistance, generalized; Timothy syndrome; TNF receptor-associated periodic fever syndrome (TRAPS); Tooth agenesis, selective, 3 and 4; Torsades de pointes; Townes-Brocks-branchiootorenal-like syndrome; Transient bullous dermolysis of the newborn; Treacher collins syndrome 1; Trichomegaly with mental retardation, dwarfism and pigmentary degeneration of retina; Trichorhinophalangeal dysplasia type I; Trichorhinophalangeal syndrome type 3; Trimethylaminuria; Tuberous sclerosis syndrome; Lymphangiomyomatosis; Tuberous sclerosis 1 and 2; Tyrosinase-negative oculocutaneous albinism; Tyrosinase-positive oculocutaneous albinism; Tyrosinemia type I; UDPglucose-4-epimerase deficiency; Ullrich congenital muscular dystrophy; Ulna and fibula absence of with severe limb deficiency; Upshaw-Schulman syndrome; Urocanate hydratase deficiency; Usher syndrome, types 1, 1B, 1D, 1G, 2A, 2C, and 2D; Retinitis pigmentosa 39; UV-sensitive syndrome; Van der Woude syndrome; Van Maldergem syndrome 2; Hennekam lymphangiectasia-lymphedema syndrome 2; Variegate porphyria; Ventriculomegaly with cystic kidney disease; Verheij syndrome; Very long chain acyl-CoA dehydrogenase deficiency; Vesicoureteral reflux 8; Visceral heterotaxy 5, autosomal; Visceral myopathy; Vitamin D-dependent rickets, types 1and 2; Vitelliform dystrophy; von Willebrand disease type 2M and type 3; Waardenburg syndrome type 1, 4C, and 2E (with neurologic involvement); Klein-Waardenberg syndrome; Walker-Warburg congenital muscular dystrophy; Warburg micro syndrome 2 and 4; Warts, hypogammaglobulinemia, infections, and myelokathexis; Weaver syndrome; Weill-Marchesani syndrome 1 and 3; Weill-Marchesani-like syndrome; Weis senbacher-Zweymuller syndrome; Werdnig-Hoffmann disease; Charcot-Marie-Tooth disease; Werner syndrome; WFS1-Related Disorders; Wiedemann-Steiner syndrome; Wilson disease; Wolfram-like syndrome, autosomal dominant; Worth disease; Van Buchem disease type 2; Xeroderma pigmentosum, complementation group b, group D, group E, and group G; X-linked agammaglobulinemia; X-linked hereditary motor and sensory neuropathy; X-linked ichthyosis with steryl-sulfatase deficiency; X-linked periventricular heterotopia; Oto-palato-digital syndrome, type I; X-linked severe combined immunodeficiency; Zimmermann-Laband syndrome and Zimmermann-Laband syndrome 2; and Zonular pulverulent cataract 3.

The instant disclosure provides lists of genes comprising pathogenic G to A or C to T mutations. Such pathogenic G to A or C to T mutations may be corrected using the methods and compositions provided herein, for example by mutating the A to a G, and/or the T to a C, thereby restoring gene function. Table 2 includes exemplary mutations that can be corrected using nucleobase editors provided herein. Table 2 includes the gene symbol, the associated phenotype, the mutation to be corrected and exemplary gRNA sequences which may be used to correct the mutations. The gRNA sequences provided in Table 2 are sequences that encode RNA that can direct Cas9, or any of the base editors provided herein, to a target site. For example, the gRNA sequences provided in Table 2 may be cloned into a gRNA expression vector, such as pFYF to encode a gRNA that targets Cas9, or any of the base editors provided herein, to a target site in order to correct a disease-related mutation. It should be appreciated, however, that additional mutations may be corrected to treat additional diseases associated with a G to A or C to T mutation. Furthermore, additional gRNAs may be designed based on the disclosure and the knowledge in the art, which would be appreciated by the skilled artisan.

TABLE 2

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80338761 | SEPT9 | NM_006640.4(SEPT9): c.262C>T (p.Arg88Trp) | CCGAGCCGGTGTCCYGGCGCACT | Hereditary neuralgic amyotrophy |
| 80338762 | SEPT9 | NM_006640.4(SEPT9): c.278C>T (p.Ser93Phe) | CCCGGCGCACTGAGCTGTYCATT, CCGGCGCACTGAGCTGTYCATTG | Hereditary neuralgic amyotrophy |
| 28934586 | CYP11B1 | NM_000497.3(CYP11B1): c.1343G>A (p.Arg448His) | GCATGCRCCAGTGCCTTGGGCGG | Deficiency of steroid 11-beta-monooxygenase |
| 748979061 | GRM6 | NM_000843.3(GRM6): c.1462C>T (p.Gln488Ter) | TGCCTRGTACCCGCCACTGCTGG | Congenital stationary night blindness, type 1B |
| 786205118 | CHKB | NM_005198.4(CHKB): c.677+1G>A | AACCTCAGRTGAGGGCAGGCAGG | Muscular dystrophy, congenital, megaconial type |
| 121965029 | IDUA | NM_000203.4(IDUA): c.266G>A (p.Arg89Gln) | GGTCCRGACCCACTGGCTGCTGG | Mucopolysaccharidosis, MPS-I-H/S, Hurler syndrome |
| 104893659 | PAX8 | NM_013953.3(PAX8): c.170G>A (p.Cys57Tyr) | GGCTRCGTCAGCAAGATCCTTGG | Thyroid agenesis |
| 104894062 | CYP11B1 | NM_000497.3(CYP11B1): c.1121G>A (p.Arg374Gln) | CTTGCRGTGGGTGCTGGCTGAGG | Deficiency of steroid 11-beta-monooxygenase |
| 104894231 | HRAS | NM_005343.2(HRAS): c.436G>A (p.Ala146Thr) | GACCTCGRCCAAGACCCGGCAGG | Costello syndrome |
| 104894335 | AQP2 | NM_000486.5(AQP2): c.523G>A (p.Gly175Arg) | CTTRGGGTAGGTCATGGCCATGG | |
| 104894341 | AQP2 | NM_000486.5(AQP2): c.568G>A (p.Ala190Thr) | CTGRCTCCAGCTGTCGTCACTGG | |
| 104894604 | NAGS | NM_153006.2(NAGS): c.971G>A (p.Trp324Ter) | AGTRGGTGAGCACAAAAGAACGG | Hyperammonemia, type III |
| 104894832 | GLA | NM_000169.2(GLA): c.982G>A (p.Gly328Arg) | GCAARGGTACCAGCTTAGACAGG | Fabry disease |
| 104894842 | GLA | NM_000169.2(GLA): c.1020G>A (p.Trp340Ter) | GTGTGRGAACGACCTCTCTCAGG | Fabry disease |
| 794726859 | SLC6A1 | NM_003042.3(SLC6A1): c.131G>A (p.Arg44Gln) | CCCGACCRGGACACGTGGAAGGG, CCCCGACCRGGACACGTGGAAGG | MYOCLONIC-ATONIC EPILEPSY |
| 794727219 | HADHA | NM_000182.4(HADHA): c.2146+1G>A | GGAGRTTGGTCTCGCAGGTTGGG, GGGAGRTTGGTCTCGCAGGTTGG | Mitochondrial trifunctional protein deficiency, Long-chain 3-hydroxyacyl-CoA dehydrogenase deficiency |
| 672601330 | ACY1 | NM_000666.2(ACY1): c.360-1G>A | TCARGTACCTGGAAGCTGTGAGG | Aminoacylase 1 deficiency |
| 794727995 | COPA | NM_001098398.1(COPA): c.721G>A (p.Glu241Lys) | TGGRAGGTTGATACCTGCCGGGG, ATGGRAGGTTGATACCTGCCGGG, CATGGRAGGTTGATACCTGCCGG | |
| 794728029 | ACTA2 | NM_001613.2(ACTA2): c.809G>A (p.Gly270Glu) | TTTCCAGRGATGGAGTCTGCTGG | Thoracic aortic aneurysms and aortic dissections |
| 397514667 | CD27 | NM_001242.4(CD27): c.158G>A (p.Cys53Tyr) | GGACTRTGACCAGCATAGAAAGG | Lymphoproliferative syndrome 2 |
| 397514668 | GDF5 | NM_000557.4(GDF5): c.1139G>A (p.Arg380Gln) | GCGAAAACRGCGGGCCCCACTGG | Brachydactyly type A2 |
| 794729274 | TTN | NM_001256850.1(TTN): c.49637G>A (p.Trp16546Ter) | AGTGAGCTRGACTCCTCCTTTGG | not provided |
| 377461670 | MYH7 | NM_000257.3(MYH7): c.5029C>T (p.Arg1677Cys) | GTTGTTGCRCCGCTCCACGATGG | Cardiomyopathy |
| 794729383 | TTN | NM_001256850.1(TTN): c.71708G>A (p.Trp23903Ter) | GTTAAATRGGGAAAGGTGGATGG | not provided |
| 121909129 | KRT86 | NM_002284.3(KRT86): c.1237G>A (p.Glu413Lys) | GGAGGGCRAGGAGCAGAGGTGGG, TGGAGGGCRAGGAGCAGAGGTGG | Beaded hair, not provided |
| 397516208 | MYH7 | NM_000257.3(MYH7): c.4276G>A (p.Glu1426Lys) | TGAGATCRAGGACTTGATGGTGG | Cardiomyopathy, not specified |
| 397516211 | MYH7 | NM_000257.3(MYH7): c.4348G>A (p.Asp1450Asn) | ACTTCRACAAGGTGGGCCCTGGG, AACTTCRACAAGGTGGGCCCTGG | Cardiomyopathy, not specified |
| 386834035 | POMGNT1 | NM_017739.3(POMGNT1): c.652+1G>A | AAAGGAGRTGCCGGCATCAGAGG | Muscle eye brain disease, Congenital muscular dystrophy-dystroglycanopathy with mental retardation, type B3 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 752034900 | ACO2 | NM_001098.2(ACO2): c.1981G>A (p.Gly661Arg) | GTGATCRGAGACGAGAACTACGG | Optic atrophy 9 |
| 57419521 | KRT81 | NM_002281.3(KRT81): c.1237G>A (p.Glu413Lys) | GGAGGGCRAGGAGCAGAGGTGGG, TGGAGGGCRAGGAGCAGAGGTGG | Beaded hair, not provided |
| 774122562 | RDH5 | NM_002905.3(RDH5): c.285G>A (p.Trp95Ter) | GTGRGTGGAGATGCACGTTAAGG | Pigmentary retinal dystrophy |
| 121908508 | SCO2 | NM_001169109.1(SCO2): c.107G>A (p.Trp36Ter) | TCCTRGCTTTTGTCAAGGCAGGG, GTCCTRGCTTTTGTCAAGGCAGG | Cardioencephalomyopathy, fatal infantile, due to cytochrome c oxidase deficiency |
| 199473684 | GLA | NM_000169.2(GLA): c.639+919G>A | CTARAGTGTAAGTTTCATGAGGG, ACTARAGTGTAAGTTTCATGAGG | Fabry disease, Fabry disease, cardiac variant |
| 121912591 | NAGS | NM_153006.2(NAGS): c.835G>A (p.Ala279Thr) | GGTGACCRCGTCGCTGGCCAAGG | Hyperammonemia, type III |
| 121912826 | COL4A3 | NM_000091.4(COL4A3): c.3044G>A (p.Gly1015Glu) | CCAGRAAGCATGGGGAACATGGG, ACCAGRAAGCATGGGGAACATGG | Benign familial hematuria |
| 730880914 | MYH7 | NM_000257.3(MYH7): c.5030G>A (p.Arg1677His) | GCGGCRCAACAACCTGCTGCAGG | Cardiomyopathy |
| 121912932 | COL5A1 | NM_000093.4(COL5A1): c.4466G>A (p.Gly1489Glu) | ATCGRGCTCATCGGTCCTCCGGG, GATCGRGCTCATCGGTCCTCCGG | Ehlers-Danlos syndrome, classic type |
| 199474822 | | m.7444G>A | AAAATCTARACAAAAAAGGAAGG | Leber optic atrophy, Aminoglycoside-induced deafness,Deafness, nonsyndromic sensorineural, mitochondrial |
| 398123050 | RTEL1 | NM_016434.3(RTEL1): c.2141+5G>A | GGTGCRTGCAGTCCGGTGGCAGG | Dyskeratosis congenita, autosomal recessive, 5 |
| 115556836 | PTCH1 | NM_000264.3(PTCH1): c.2183C>T (p.Thr728Met) | ACTTCRTACAGGGGGGCTCGAGG | Holoprosencephaly 7, not specified, not provided |
| 201540674 | RTEL1 | RTEL1:c.2402G>A (p.Arg801His) | TCCAGCRCTGCCAAGCCTGCTGG | Idiopathic fibrosing alveolitis,chronic form, Dyskeratosiscongenita, autosomal recessive, 5, PULMONARY FIBROSISAND/OR BONE MARROW FAILURE, TELOMERE-RELATED, 3 |
| 62638208 | GRM6 | NM_000843.3(GRM6): c.1565G>A (p.Cys522Tyr) | TGCCCTRCGGGCCGGGGAGCGG | Congenital stationary night blindness, type 1B, not provided |
| 62638625 | GRM6 | NM_000843.3(GRM6): c.2341G>A (p.Glu781Lys) | TTCAACRAGGCCAAGCCCATCGG | Congenital stationary night blindness, type 1B, not provided |
| 796053008 | SCN1A | NM_001165963.1(SCN1A): c.4285G>A (p.Ala1429Thr) | AATAGRCCACATTCAAAGGATGG | not provided |
| 121917756 | HRAS | NM_005343.2(HRAS): c.187G>A (p.Glu63Lys) | GGAGRAGTACAGCGCCATGCGGG, AGGAGRAGTACAGCGCCATGCGG | Myopathy, congenital, with excess of muscle spindles |
| 121917775 | VIM | NM_003380.3(VIM): c.451G>A (p.Glu151Lys) | CCTCTACRAGGAGGAGATGCGGG, ACCTCTACRAGGAGGAGATGCGG | Cataract, nuclear diffuse nonprogressive, not provided |
| 121917995 | SCN1A | NM_006920.4(SCN1A): c.4874G>A (p.Arg1625Gln) | TCCRAGTGATCCGTCTTGCTAGG | Generalized epilepsy with febrile seizures plus, type 2, Epileptic encephalopathy Lennox-Gastaut type, not provided |
| 121918805 | SCN1A | NM_006920.4(SCN1A): c.4063G>A (p.Val1355Ile) | ATGGGCRTAAATTTGTTTGCTGG | Generalized epilepsy with febrile seizures plus, type 1, not provided |
| 768431507 | TTN | NM_001256850.1(TTN): c.49243C>T (p.Arg16415Ter) | CATTTCRGAACACTGAGCCAAGG | not provided |
| 368138001 | NPHP3 | NM_153240.4(NPHP3): c.3373C>T (p.Arg1125Ter) | AACTCRCTCCCTCATTTCTAAGG | Adolescent nephronophthisis, Renal-hepatic-pancreatic dysplasia, not provided |
| 730880440 | GLA | NM_000169.2(GLA): c.1019G>A (p.Trp340Ter) | GTGTRGGAACGACCTCTCTCAGG | not provided |
| 730880450 | GLA | NM_000169.2(GLA): c.713G>A (p.Ser238Asn) | GAAAARTATAAAGAGTATCTTGG | not provided |
| 267606745 | COL4A3 | NM_000091.4(COL4A3): c.3499G>A (p.Gly1167Arg) | GCCRGAGAAAAGGGAGAAACGGG, AGCCRGAGAAAAGGGAGAAACGG | Alport syndrome, autosomal dominant |
| 267606961 | POMGNT1 | NM_001243766.1(POMGNT1): c.1425G>A (p.Trp475Ter) | GGGATTGRGACATGTGGATGCGG | |
| 267607132 | TOP1 | NM_003286.2(TOP1): c.1748G>32 (p.Gly583=) | CATGGAGGRCTTGACAGCCAAGG | |
| 398122933 | CD27 | NM_001242.4(CD27): c.24G>A (p.Trp8Ter) | CCTGGTGRCTGTGCGTTCTGGGG, CCCTGGTGRCTGTGCGTTCTGGG | Lymphoproliferative syndrome 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 398122944 | CRYGC | NM_020989.3(CRYGC): c.471G>A (p.Trp157Ter) | CTGRGGGGCCATGGATGCTAAGG | Cataract, coppock-like |
| 398123019 | RTEL1 | NM_032957.4(RTEL1): c.823G>A (p.Glu275Lys) | CTTTGACRAAGCTCACAACGTGG | Dyskeratosis congenita, autosomal recessive, 5 |
| 281865424 | TYRP1 | NM_000550.2(TYRP1): c.1067G>A (p.Arg356Gln) | AGTTTCCRAAACACAGTGGAAGG | Oculocutaneous albinism type 3 |
| 111033564 | PRSS1 | NM_002769.4(PRSS1): c.235G>A (p.Glu79Lys) | ACAACATCRAAGTCCTGGAGGGG | Hereditary pancreatitis |
| 121434424 | GDF1 | NM_001492.5(GDF1): c.485G>A (p.Gly162Asp) | GGGCGRCTGGGAGCTGAGCGTGG | Tetralogy of Fallot, not provided |
| 74315389 | GDF5 | NM_000557.4(GDF5): c.1471G>A (p.Glu491Lys) | GCAGTATRAGGACATGGTCGTGG | Symphalangism, proximal, 1b |
| 74315511 | SCO2 | NM_005138.2(SCO2): c.418G>A (p.Glu140Lys) | CCCAGACRAGCTGGAGAAGCTGG | Myopia 6, Cardioencephalomyopathy, fatal infantile, due tocytochrome c oxidase deficiency, not provided |
| 137853207 | DDC | NM_001082971.1(DDC): c.304G>A (p.Gly102Ser) | CATCRGCTTCTCCTGGGTGAGGG, GCATCRGCTTCTCCTGGGTGAGG | Deficiency of aromatic-L-amino-acid decarboxylase |
| 786201031 | SPECC1L | NM_015330.4(SPECC1L): c.3247G>A (p.Gly1083Ser) | TGTCRGCATCAAATCCACACTGG | Opitz G/BBB syndrome |
| 387906858 | KCNJ13 | NM_002242.4(KCNJ13): c.496C>T (p.Arg166Ter) | AAAAGCTCRATTTTTTGGCCGGG | Leber congenital amaurosis 16 |
| 387907183 | ALG11 | NM_001004127.2(ALG11): c.1192G>A (p.Glu398Lys) | TGGAACRAGCATTTTGGGATTGG | Congenital disorder of glycosylation type 1P |
| 72646831 | TTN | NM_001267550.2(TTN): c.57331C>T (p.Arg19111Ter) | CCATGCTGGAGGGGTGATCYGAA | Primary dilated cardiomyopathy, Dilated cardiomyopathy 1G, not provided |
| 750586158 | RAD50 | NM_005732.3(RAD50): c.3598C>T (p.Arg1200Ter) | CCTTGGATATGCGAGGAYGATGC | Hereditary cancer-predisposing syndrome |
| 34516117 | KCNQ1 | NM_000218.2(KCNQ1): c.1799C>T (p.Thr600Met) | CCTTTGTCCCCGCAGGTGAYGCA | Long QT syndrome, Congenital long QT syndrome, Cardiac arrhythmia |
| 786205700 | RTEL1 | NM_032957.4(RTEL1): c.1523C>T (p.Pro508Leu) | CCAGCGGCACGCTGGCCCYGGTG | PULMONARY FIBROSIS AND/OR BONE MARROW FAILURE, TELOMERE-RELATED, 3 |
| 786205701 | RTEL1 | NM_032957.4(RTEL1): c.2149C>T (p.Gln717Ter) | CCAGGGCTGTGAACYAGGCCATC | PULMONARY FIBROSIS AND/OR BONE MARROW FAILURE, TELOMERE-RELATED, 3 |
| 104893940 | ARG1 | NM_000045.3(ARG1): c.871C>T (p.Arg291Ter) | CCAGAAGAAGTAACTYGAACAGT | Arginase deficiency |
| 104894069 | CYP11B1 | NM_000497.3(CYP11B1): c.124C>T (p.Pro42Ser) | CCCTTTGAAGCCATGYCCCGGCG, CCTTTGAAGCCATGYCCCGGCGT | Congenital adrenal hyperplasia, Deficiency of steroid 11-beta-monooxygenase |
| 145100473 | SCO2 | NM_001169109.1(SCO2): c.341G>A (p.Arg114His) | CCGGAAGTCAGCCTTGCAGYGAG | Myopia 6 |
| 104894333 | AQP2 | NM_000486.5(AQP2): c.374C>T (p.Thr125Met) | CCCAGCTCAGCAACAGCAYGAC, CCCAGCTCAGCAACAGCAYGACG, CCAGCTCAGCAACAGCAYGACGG | |
| 794726710 | SCN1A | NM_001165963.1(SCN1A): c.3637C>T (p.Arg1213Ter) | CCTGAGAAGGACGTGTTTCYGAA | Severe myoclonic epilepsy in infancy, not provided |
| 794726752 | SCN1A | NM_001165963.1(SCN1A): c.4573C>T (p.Arg1525Ter) | CCGCAAAAGCCTATACCTYGACC | Severe myoclonic epilepsy in infancy, not provided |
| 794726759 | SCN1A | NM_001165963.1(SCN1A): c.4933C>T (p.Arg1645Ter) | CCGTCTTGCTAGGATTGGCYGAA | Severe myoclonic epilepsy in infancy |
| 104894837 | GLA | NM_000169.2(GLA): c.436C>T (p.Pro146Ser) | CCTGCGCAGGCTTCYCTGGGAGT | Fabry disease |
| 200970763 | PIEZO1 | NM_001142864.3(PIEZO1): c.2344G>A (p.Gly782Ser) | CCGCTCAGCCACCAGGCYCCACT | Xerocytosis |
| 794726988 | RAD51D | NM_002878.3(RAD51D): c.955C>T (p.Gln319Ter) | CCTGGGGGACCTCAGAGYAGAGT | Breast-ovarian cancer, familial 4 |
| 794728015 | SOX18 | NM_018419.2(SOX18): c.481C>T (p.Gln161Ter) | CCGGCCGCGCCGCAAGAAGYAGG, CCGCGCCGCAAGAAGYAGGCGCG | Hypotrichosis-lymphedema-telangiectasia syndrome |
| 794728540 | KCNQ1 | NM_000218.2(KCNQ1): c.1801C>T (p.Gln601Ter) | CCCCGCAGGTGACGYAGCTGGAC | Cardiac arrhythmia |
| 28940869 | POMGNT1 | NM_017739.3(POMGNT1): c.1324C>T (p.Arg442Cys) | CCCAGCACTACTGTACYGTGTGG, CCAGCACTACTGTACYGTGTGGA | Congenital muscular dystrophy |
| 794729279 | TTN | NM_001256850.1(TTN): c.58702C>T (p.Arg19568Ter) | CCCTAAAGTCACTTGGYAAAA, CCCTAAAGTCACTTGGYAAAAG, CCTAAAGTCACTTGGYAAAAGT | not provided |
| 794729305 | TTN | NM_001256850.1(TTN): c.96304C>T (p.Arg32102Ter) | CCGTGTAGGACAGGCCYGAGAAA | not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 794729384 | TTN | NM_001256850.1(TTN): c.81193C>T (p.Arg27065Ter) | CCATTCAGAGCTTAYGAGGGACA | not provided |
| 397517326 | CDH23 | NM_022124.5(CDH23): c.3628C>T (p.Gln1210Ter) | CCCCCGTGTTCACAYAGCAGCAG | Usher syndrome, type 1D |
| 147708782 | MYH2 | NM_017534.5(MYH2): c.706G>A (p.Ala236Thr) | CCTCACGGTCTTGGYGTTGCCAA | Inclusion body myopathy 3 |
| 121908189 | MFRP | NM_031433.3(MFRP): c.523C>T (p.Gln175Ter) | CCACTGCGTGTGGCATATCYAGG | Nanophthalmos 2 |
| 121908350 | CDH23 | NM_022124.5(CDH23): c.3880C>T (p.Gln1294Ter) | CCAGGCCCCGCCCTTCAACYAGG, CCCCGCCCTTCAACYAGGGCTTC | Usher syndrome, type 1D |
| 121908490 | SGCE | NM_003919.2(SGCE): c.304C>T (p.Arg102Ter) | CCGACCTGGATGGCTTYGATATA | Myoclonic dystonia |
| 121909106 | FOXC2 | NM_005251.2(FOXC2): c.374C>T (p.Ser125Leu) | CCGCCACAACCTCTYGCTCAACG | Distichiasis-lymphedema syndrome |
| 121909117 | SOX10 | NM_006941.3(SOX10): c.470C>T (p.Ala157Val) | CCCCTTCATCGAGGAGGYTGAGC, CCCTTCATCGAGGAGGYTGAGCG, CCTTCATCGAGGAGGYTGAGCGG | Waardenburg syndrome type 4C |
| 121909501 | TDGF1 | NM_001174136.1(TDGF1): c.326C>T (p.Pro109Leu) | CCCCATGACACCTGGCTGCYCAA, CCCATGACACCTGGCTGCYCAAG, CCATGACACCTGGCTGCYCAAGA | Forebrain defects |
| 121909511 | CHRNE | NM_000080.3(CHRNE): c.865C>T (p.Leu289Phe) | CCAGACCGTCTTCTTGTTCYTCA, CCGTCTTCTTGTTCYTCATTGCC | Myasthenia, familial infantile, 1 |
| 121909512 | CHRNE | NM_000080.3(CHRNE): c.422C>T (p.Pro141Leu) | CCGTGACGTGGCTGCCTCYGGCC | MYASTHENIC SYNDROME, CONGENITAL, 4B, FAST-CHANNEL |
| 121909595 | CRYGD | NM_006891.3(CRYGD): c.43C>T (p.Arg15Cys) | CCGGGGCTTCCAGGGCYGCCACT | Cataract 4 |
| 121912420 | SERPIND1 | NM_000185.3(SERPIND1): c.1385C>T (p.Pro462Leu) | CCACGGTGGGGTTCATGCYGCTG | Heparin cofactor II deficiency |
| 111033571 | TRIM32 | NM_012210.3(TRIM32): c.388C>T (p.Pro130Ser) | CCGGGAGGCAGACCATCAGYCTC | Bardet-Biedl syndrome, Bardet-Biedl syndrome 11 |
| 121912700 | ACY1 | NM_000666.2(ACY1): c.589C>T (p.Arg197Trp) | CCTCCCCAGGGGTGYGGGTTACC | Aminoacylase 1 deficiency |
| 121912978 | CYP11B2 | NM_000498.3(CYP11B2): c.554C>T (p.Thr185Ile) | CCCGGGGGAGCCTGAYCCTGGAC, CCGGGGGAGCCTGAYCCTGGACG | Corticosterone methyloxidase type 2 deficiency |
| 730882050 | ALG14 | NM_144988.3(ALG14): c.194C>T (p.Pro65Leu) | CCAATGCCTACTCACYTAGACAT | Myasthenic syndrome, congenital, without tubular aggregates |
| 761807131 | TTN | NM_001256850.1(TTN): c.46513+1G>A | CCATGTCCAAACTTAYGCTTTGG | not provided |
| 730882144 | MFRP | NM_031433.3(MFRP): c.1549C>T (p.Arg517Trp) | CCCTGCTACCAGCATTTCYGGAG, CCTGCTACCAGCATTTCYGGAGG | Microphthalmia, isolated 5 |
| 61752068 | RS1 | NM_000330.3(RS1): c.305G>A (p.Arg102Gln) | CCTTGACTGTTGAGCYGGGCCTT | Juvenile retinoschisis, not provided |
| 119456962 | NPHP3 | NM_153240.4(NPHP3): c.1729C>T (p.Arg577Ter) | CCTCCTTGATTATTAAAYGACTA, CCTTGATTATTAAAYGACTAACT | Adolescent nephronophthisis, Renal-hepatic-pancreaticdysplasia, Meckel syndrome type 7, not provided |
| 74315310 | FCGR1A | NM_000566.3(FCGR1A): c.274C>T (p.Arg92Ter) | CCAGAGAGGTCTCTCAGGGYGAA | |
| 41469351 | CCR5 | NM_000579.3(CCR5): c.-229C>T | CCCGTAAATAAACCTTYAGACCA, CCGTAAATAAACCTTYAGACCAG | |
| 62638185 | RDH5 | NM_002905.3(RDH5): c.218C>T (p.Ser73Phe) | CCTGCAGCGGGTGGCCTYCTCCC | |
| 796053004 | SCN1A | NM_001165963.1(SCN1A): c.3985C>T (p.Arg1329Ter) | CCTCTAAGAGCCTTATCTYGATT | Severe myoclonic epilepsy in infancy, not provided |
| 796053103 | SCN1A | NM_001165963.1(SCN1A): c.5710C>T (p.Gln1904Ter) | CCTTCCAAGGTCTCCTATYAGCC, CCAAGGTCTCCTATYAGCCAATC | not provided |
| 121917886 | P2RY12 | NM_022788.4(P2RY12): c.793C>T (p.Arg265Trp) | CCCTGAGCCAAACCYGGGATGTC | Platelet-type bleeding disorder 8 |
| 121917903 | ERCC6 | NM_000124.3(ERCC6): c.229C>T (p.Arg77Ter) | CCCTGCTGCACATCGACYGACAT, CCTGCTGCACATCGACYGACATC | UV-sensitive syndrome |
| 121918450 | ITGB3 | NM_000212.2(ITGB3): c.2248C>T (p.Arg750Ter) | CCATCATCACCATCCACGACYGAA | Glanzmann thrombasthenia |
| 727503949 | GLA | NM_000169.2(GLA): c.658C>T (p.Arg220Ter) | CCCAATTATACAGAAATCYGACA, CCAATTATACAGAAATCYGACAG | Fabry disease |
| 202102042 | NPPA | NM_006172.3(NPPA): c.449G>A (p.Arg150Gln) | CCCCAGTTCCTCTTACCYGGAAG, CCAGTTCCTCTTACCYGGAAGCT | Atrial standstill 2 |
| 202003805 | PRSS1 | NM_002769.4(PRSS1): c.47C>T (p.Ala16Val) | CCACTCCAGTTGCTGYCCCCTTT | Hereditary pancreatitis |
| 587781698 | ATM | NM_000051.3(ATM): c.8998C>T (p.Gln3000Ter) | CCTTAGTGATATTGACYAGAGTT | Hereditary cancer-predisposing syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 148231754 | TTN | NM_001256850.1(TTN): c.83086+5G>A | CCCTTCCCATGACAAATAYGTAC, CCTTCCCATGACAAATAYGTACC | not provided |
| 587781756 | RAD51D | NM_002878.3(RAD51D): c.451C>T (p.Gln151Ter) | CCGCCTCCTCCAGCTGCTTYAGG, CCTCCTCCAGCTGCTTYAGGCTA | Hereditary cancer-predisposing syndrome |
| 137853289 | ABCA12 | NM_173076.2(ABCA12): c.6610C>T (p.Arg2204Ter) | CCATGTTTTTTCCTTGYGACTC | Autosomal recessive congenital ichthyosis 4B |
| 116840809 | RPL35A | NM_000996.2(RPL35A): c.304C>T (p.Arg102Ter) | CCATTGGACACAGAATCYGAGTG | Diamond-Blackfan anemia 5 |
| 587782695 | RAD51D | NM_002878.3(RAD51D): c.547C>T (p.Gln183Ter) | CCAGATGCTGGATGTGCTGYAGG | Hereditary cancer-predisposing syndrome |
| 119462978 | KIRREL3 | NM_032531.3(KIRREL3): c.118C>T (p.Arg40Trp) | CCAAGGACAAGTTTYGGAGAATG | Mental retardation, autosomal dominant 4 |
| 398123812 | SGCE | NM_003919.2(SGCE): c.709C>T (p.Arg237Ter) | CCCGTTTTCTTCTTGTTTAYGAG, CCGTTTTCTTCTTGTTTAYGAGA | not provided |
| 397518485 | TRAF3IP2 | NM_147686.3(TRAF3IP2): c.1580C>T (p.Thr527Ile) | CCCACCTGCTTCAGAACAYTCA, CCACCTGGCTTCAGAACAYTCAT, CCTGGCTTCAGAACAYTCATGTC | Candidiasis, familial, 8 |
| 794726839 | SCN1A | NM_001165963.1(SCN1A): c.4985C>T (p.Ala1662Val) | CCGCACGCTGCTCTTTGYTTGA | Severe myoclonic epilepsy in infancy |
| 60035576 | KRT10 | NM_000421.3(KRT10): c.1300C>T (p.Gln434Ter) | CCAGAATACTGAATACCAAYAAC | Bullous ichthyosiform erythroderma, not provided |
| 779874042 | TTN | NM_001256850.1(TTN): c.77716G>T (p.Glu25906Ter) | CCCACACCAGCTGCATTTTHAGC, CCACACCAGCTGCATTTTHAGCA | not provided |
| 121434219 | ATM | NM_000051.3(ATM): c.9139C>T (p.Arg3047Ter) | CCCCAAAAATCTCAGCYGACTTT, CCCAAAAATCTCAGCYGACTTTT, CCAAAAATCTCAGCYGACTTTTC | Ataxia-telangiectasia syndrome |
| 121434306 | LPAR6 | NM_005767.5(LPAR6): c.463C>T (p.Gln155Ter) | CCCGCCGTTTTTGTTYAGTCTAC, CCGCCGTTTTTGTTYAGTCTACC | Hypotrichosis 8 |
| 121434405 | RPL5 | NM_000969.3(RPL5): c.67C>T (p.Arg23Ter) | CCAAGTGAAATTTAGAAGAYGAC | Aase syndrome |
| 121434410 | PRKRA | NM_003690.4(PRKRA): c.665C>T (p.Pro222Leu) | CCTTGAGGAATTCTCYTGGTGAA | Dystonia 16 |
| 121434534 | CYP19A1 | NM_031226.2(CYP19A1): c.1303C>T (p.Arg435Cys) | CCATTTGGCTTGGGCCCYGTGG | Aromatase deficiency |
| 121434571 | ERCC5 | NM_000123.3(ERCC5): c.2375C>T (p.Ala792Val) | CCCATGGAAGCAGAGGYGCAGTG, CCATGGAAGCAGAGGYGCAGTGC | Xeroderma pigmentosum, group G |
| 137852293 | PHKA2 | NM_000292.2(PHKA2): c.3341C>T (p.Thr1114Ile) | CCCTTTGGTAGATGAYCCCGCAT, CCTTTGGTAGATGAYCCCGCATG | Glycogen storage disease IXa2 |
| 74315359 | PINK1 | NM_032409.2(PINK1): c.938C>T (p.Thr313Met) | CCTGGGCCATGGCCGGAYGCTGT | Parkinson disease 6, autosomal recessive early-onset |
| 372635387 | CHRNE | NM_000080.3(CHRNE): c.37G>A (p.Gly13Arg) | CCGTACCGAGAAGCCYCAAGAGG | MYASTHENIC SYNDROME, CONGENITAL, 4B, FAST-CHANNEL |
| 74315520 | SOX10 | NM_006941.3(SOX10): c.1129C>T (p.Gln377Ter) | CCAGCCATCCACCTCAYAGATCG | Waardenburg syndrome type 4C, Waardenburg syndrome type 2E, with neurologic involvement |
| 74315521 | SOX10 | NM_006941.3(SOX10): c.748C>T (p.Gln250Ter) | CCCCGAAGACAGAGCTGYAGTCG, CCCGAAGACAGAGCTGYAGTCGG, CCGAAGACAGAGCTGYAGTCGGG | Peripheral demyelinating neuropathy, central dysmyelination, Waardenburg syndrome, and Hirschsprung disease |
| 137852824 | PCSK1 | NM_000439.4(PCSK1): c.920C>T (p.Ser307Leu) | CCATCTTCGTCTGGGCTTYGGGA | Proprotein convertase 1/3 deficiency |
| 137852973 | BSCL2 | NM_001122955.3(BSCL2): c.461C>T (p.Ser154Leu) | CCCTGTTGCCAATGTCTYGCTGA, CCTGTTGCCAATGTCTYGCTGAC | Silver spastic paraplegia syndrome |
| 137852974 | BSCL2 | NM_001122955.3(BSCL2): c.1015C>T (p.Arg339Ter) | CCTCCACAGGTTAACATCYGAAA, CCACAGGTTAACATCYGAAAAAG | Congenital generalized lipodystrophy type 2 |
| 137853211 | DDC | NM_001082971.1(DDC): c.272C>T (p.Ala91Val) | CCCGGCCATGCTTGYGGACATGC | Deficiency of aromatic-L-amino-acid decarboxylase |
| 387906570 | APOA1 | NM_000039.1(APOA1): c.67C>T (p.Gln23Ter) | CCAGGCTCGGCATTTCTGGYAGC | Tangier disease |
| 387906669 | ACP5 | NM_001111035.1(ACP5): c.667C>T (p.Gln223Ter) | CCCACTGCCTGGTCAAGYAGCTA, CCACTGCCTGGTCAAGYAGCTAC | Spondyloenchondrodysplasia with immune dysregulation |
| 80051519 | CYP19A1 | NM_031226.2(CYP19A1): c.1094G>A (p.Arg365Gln) | CCACGACAGGCTGGTACYGCATG | Aromatase deficiency |
| 387907268 | PRCD | NM_001077620.2(PRCD): c.64C>T (p.Arg22Ter) | CCGCCGATTTGCCAACYGAGTCC | Retinitis pigmentosa 36 |
| 387907279 | FAN1 | NM_014967.4(FAN1): c.2245C>T (p.Arg749Ter) | CCGCCTTTCACTGTATCAGYGAG, CCTTTCACTGTATCAGYGAGCCG | Interstitial nephritis, karyomegalic |
| 543267101 | AARS2 | NM_020745.3(AARS2): c.2893G>A (p.Gly965Arg) | CCAGGTCAGTAGTGCTTCYGGTG | Leukoencephalopathy, progressive, with ovarian failure |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777592 | AARS2 | NM_020745.3(AARS2): c.1213G>A (p.Glu405Lys) | CCAGGAAGGCTGCCTYGTCCTCT | Leukoencephalopathy, progressive, with ovarian failure |
| 587777125 | AASS | NM_005763.3(AASS): c.194G>A (p.Arg65Gln) | CCTTATCATGAATGGCCYGCCGA | Hyperlysinemia |
| 121434578 | ABAT | NM_000663.4(ABAT): c.659G>A (p.Arg220Lys) | GGGARGACCATGGGTAAGGAGGG, TGGGARGACCATGGGTAAGGAGG, CCATGGGARGACCATGGGTAAGG | Gamma-aminobutyric acid transaminase deficiency |
| 724159990 | ABAT | NM_000663.4(ABAT): c.631C>T (p.Leu211Phe) | CCCCGACTACAGCATCYTCTCCT, CCCGACTACAGCATCYTCTCCTT, CCGACTACAGCATCYTCTCCTTC | Gamma-aminobutyric acid transaminase deficiency |
| 137854495 | ABCA1 | NM_005502.3(ABCA1): c.2810C>T (p.Ala937Val) | CCTGGGCCACAATGGAGYGGGGA | Tangier disease |
| 28940270 | ABCA12 | NM_173076.2(ABCA12): c.4541G>A (p.Arg1514His) | ATGTTCTCRCCCGAAGTATATGGG | Autosomal recessive congenital ichthyosis 4A |
| 121909181 | ABCA3 | NM_001089.2(ABCA3): c.3426G>A (p.Trp1142Ter) | CTGRCTCTCTGCTCTGCTGTGGG, TCTGRCTCTCTGCTCTGCTGTGG | Surfactant metabolism dysfunction, pulmonary, 3 |
| 61750061 | ABCA4 | NM_000350.2(ABCA4): c.3106G>A (p.Glu1036Lys) | GTCCCAGRAGGAGGCCCAGCTGG | Stargardt disease 1, not provided |
| 61751399 | ABCA4 | NM_000350.2(ABCA4): c.3364G>A (p.Glu1122Lys) | GGACRAGGCCGACCTCCTTGGGG, TGGACRAGGCCGACCTCCTTGGG, ATGGACRAGGCCGACCTCCTTGG | Stargardt disease 1, not provided |
| 1800553 | ABCA4 | NM_000350.2(ABCA4): c.5882G>A (p.Gly1961Glu) | TGTCGRAGTTCGCCCTGGAGAGG | Stargardt disease 1, Cone-rod dystrophy 3, not provided |
| 794727531 | ABCA4 | NM_000350.2(ABCA4): c.4429C>T (p.Gln1477Ter) | CCCAGCTGTTCCAGAAGYAGAAA, CCAGCTGTTCCAGAAGYAGAAAT | Stargardt disease 1 |
| 794727903 | ABCA4 | NM_000350.2(ABCA4): c.880C>T (p.Gln294Ter) | CCATCGGCCGAGTATGYAGGACT | Stargardt disease 1, Cone-rod dystrophy 3 |
| 61748550 | ABCA4 | NM_000350.2(ABCA4): c.1222C>T (p.Arg408Ter) | CCTGATTCACCTGCAGCAYGAAG | Retinitis pigmentosa 19, Stargardt disease 1, Cone-rod dystrophy 3, Age-related macular degeneration 2, not provided |
| 61750130 | ABCA4 | NM_000350.2(ABCA4): c.4139C>T (p.Pro1380Leu) | CCCACAGATCGTGCTCCYGGCTA, CCACAGATCGTGCTCCYGGCTAC | Stargardt disease 1, not provided |
| 28938473 | ABCA4 | NM_000350.2(ABCA4): c.5908C>T (p.Leu1970Phe) | CCTAGTGCTTTGGCYTCCTGGGA | Stargardt disease, not provided |
| 72549401 | ABCB11 | NM_003742.2(ABCB11): c.1723C>T (p.Arg575Ter) | GGGATTTCRGATGAGGGCTCTGG | Progressive familial intrahepatic cholestasis 2 |
| 72552778 | ABCB4 | NM_018849.2(ABCB4): c.959C>T (p.Ser320Phe) | CCTTCTGGTATGGATYCACTCTA | Cholecystitis, Progressive familial intrahepatic cholestasis 3, Cholestasis, intrahepatic, of pregnancy 3 |
| 121918440 | ABCB4 | NM_018849.2(ABCB4): c.2869C>T (p.Arg957Ter) | CCTATGCCGGTTGTTTTYGATTT | Progressive familial intrahepatic cholestasis 3, Cholestasis, intrahepatic, of pregnancy 3 |
| 121918442 | ABCB4 | NM_018849.2(ABCB4): c.3502C>T (p.Pro1168Ser) | CCTTTCATCGAGACGTTAYCCCA | Cholecystitis |
| 72558200 | ABCC2 | NM_000392.4(ABCC2): c.3449G>A (p.Arg1150His) | GGCRTCTGGACTCTGTCACCAGG | Dubin-Johnson syndrome |
| 63749823 | ABCC6 | NM_001171.5(ABCC6): c.3961G>A (p.Gly1321Ser) | GAGRGTGGGATCTGGATCGACGG | Pseudoxanthoma elasticum |
| 28939701 | ABCC6 | NM_001171.5(ABCC6): c.3412C>T (p.Arg1138Trp) | CCAGGGCAGCACAGTGGTCYGGG | Pseudoxanthoma elasticum |
| 72653744 | ABCC6 | NM_001171.5(ABCC6): c.3490C>T (p.Arg1164Ter) | CCAGAGGATCAGTTTCCCGYGAC | Pseudoxanthoma elasticum |
| 63750459 | ABCC6 | NM_001171.5(ABCC6): c.3389C>T (p.Thr1130Met) | CCCACATGGCTGAGAYGTTCCAG, CCACATGGCTGAGAYGTTCCAGG | Pseudoxanthoma elasticum |
| 63750759 | ABCC6 | NM_001171.5(ABCC6): c.3940C>T (p.Arg1314Trp) | CCTGGCCAGTGGGCTGCTGYGGC, CCAGTGGGCTGCTGYGGCTCCAG | Pseudoxanthoma elasticum, Generalized arterial calcification of infancy 2 |
| 193922402 | ABCC8 | NM_000352.4(ABCC8): c.4306C>T (p.Arg1436Ter) | CCTCTTCAGCGGCACCATCYGGT | Persistent hyperinsulinemic hypoglycemia of infancy, familial hyperinsulinism |
| 387906805 | ABCC9 | NM_005691.3(ABCC9): c.4640C>T (p.Thr1547Ile) | CCACTTTGGTGATGAYCAACAAG | Atrial fibrillation, familial, 12 |
| 387907228 | ABCC9 | NM_005691.3(ABCC9): c.3346C>T (p.Arg1116Cys) | CCTTGGAATCTCTAACTYGCTCA | Hypertrichotic osteochondrodysplasia |
| 11146842 | ABCD1 | NM_000033.3(ABCD1): c.1850G>A (p.Arg617His) | TGGCCCRCATGTTCTACCACAGG | Adrenoleukodystrophy |
| 150346282 | ABCD1 | NM_000033.3(ABCD1): c.1825G>A (p.Glu609Lys) | GGTGGCRAGAAGCAGAGAATCGG | Adrenoleukodystrophy |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 128624213 | ABCD1 | NM_000033.3(ABCD1): c.871G>A (p.Glu291Lys) | TCGRAGGAGATCGCCTTCTATGG | Adrenoleukodystrophy |
| 128624218 | ABCD1 | NM_000033.3(ABCD1): c.796G>A (p.Gly266Arg) | GTTCRGGGAGCTGGTGGCAGAGG | Adrenoleukodystrophy |
| 398123102 | ABCD1 | NM_000033.3(ABCD1): c.1553G>A (p.Arg518Gln) | TCCRGATCCTGGGTGGGCTCTGG | Adrenoleukodystrophy |
| 398123107 | ABCD1 | NM_000033.3(ABCD1): c.1802G>A (p.Trp601Ter) | GACTRGAAGGACGTCCTGTCGGG, TGACTRGAAGGACGTCCTGTCGG | Adrenoleukodystrophy |
| 398123105 | ABCD1 | NM_000033.3(ABCD1): c.1679C>T (p.Pro560Leu) | CCAGGTGATCTACCYGGACTCAG | Adrenoleukodystrophy |
| 398123106 | ABCD1 | NM_000033.3(ABCD1): c.1771C>T (p.Arg591Trp) | CCTGCACCACATCCTGCAGYGGG | Adrenoleukodystrophy |
| 587777603 | ABHD12 | NM_015600.4(ABHD12): c.477G>A (p.Trp159Ter) | CCAAGGCATCCTCATAYCACATC | Polyneuropathy, hearing loss, ataxia, retinitis pigmentosa, and cataract |
| 387906517 | ABL1 | NM_007313.2(ABL1): c.763G>A (p.Glu255Lys) | CAAGTGGRAGATGGAACGCACGG | |
| 121913459 | ABL1 | NM_007313.2(ABL1): c.1001C>T (p.Thr334Ile) | CCCCCGTTCTATATCATCAYTGA, CCCCGTTCTATATCATCAYTGAG, CCCGTTCTATATCATCAYTGAGT, CCGTTCTATATCATCAYTGAGTT | |
| 368949613 | ACAD9 | NM_014049.4(ACAD9): c.1249C>T (p.Arg417Cys) | CCGTACGAGCGCATACTGYGTGA | Acyl-CoA dehydrogenase family, member 9, deficiency of |
| 121434278 | ACADM | NM_000016.5(ACADM): c.583G>A (p.Gly195Arg) | CCAACRGAGGAAAAGCTAATTGG | Medium-chain acyl-coenzyme A dehydrogenase deficiency, not provided |
| 1799958 | ACADS | NM_000017.3(ACADS): c.625G>A (p.Gly209Ser) | TCAGRGCATCAGTGCCTTCCTGG | Deficiency of butyryl-CoA dehydrogenase, not specified, not provided |
| 387906951 | ACADS | NM_000017.3(ACADS): c.323G>A (p.Gly108Asp) | AGCCGTGRCTGCGCCTCCACCGG | Deficiency of butyryl-CoA dehydrogenase |
| 28940872 | ACADS | NM_000017.3(ACADS): c.1147C>T (p.Arg383Cys) | CCGGCAGAGCGGCACTACYGCGA | Deficiency of butyryl-CoA dehydrogenase, not provided |
| 28940874 | ACADS | NM_000017.3(ACADS): c.575C>T (p.Ala192Val) | CCAATGCCTGGGAGGYTTCGGCT | Deficiency of butyryl-CoA dehydrogenase |
| 28941773 | ACADS | NM_000017.3(ACADS): c.1058C>T (p.Ser353Leu) | CCAAGCTGGCCGCCTYGGAGGCC | Deficiency of butyryl-CoA dehydrogenase, not provided |
| 121908006 | ACADS | NM_000017.3(ACADS): c.973C>T (p.Arg325Trp) | CCTGGCCCTGGAGAGTGCCYGGC, CCCTGGAGAGTGCCYGGCTGCTG | Deficiency of butyryl-CoA dehydrogenase, not provided |
| 61732144 | ACADS | NM_000017.3(ACADS): c.319C>T (p.Arg107Cys) | CCATGGAGGAGATCAGCYGTGGC | Deficiency of butyryl-CoA dehydrogenase, not provided |
| 147442301 | ACADS | NM_000017.3(ACADS): c.164C>T (p.Pro55Leu) | CCGAGAAGGAGTTGTTTCYCATT | Deficiency of butyryl-CoA dehydrogenase |
| 188094280 | ACADSB | NM_001609.3(ACADSB): c.1159G>A (p.Glu387Lys) | ATCRAGTGGATGGGGGAGTAGG | Deficiency of 2-methylbutyryl-CoA dehydrogenase |
| 137852649 | ACADSB | NM_001609.3(ACADSB): c.763C>T (p.Leu255Phe) | CCTGAAAACAAATTGGGGYTCAG | Deficiency of 2-methylbutyryl-CoA dehydrogenase |
| 533055438 | ACADVL | NM_000018.3(ACADVL): c.1316G>A (p.Gly439Asp) | GGGGGRTATGGGCTTCATGAAGG | not provided |
| 2309689 | ACADVL | NM_000018.3(ACADVL): c.1322G>A (p.Gly441Asp) | TATGGRCTTCATGAAGGTACAGG | Very long chain acyl-CoA dehydrogenase deficiency, not provided |
| 766742117 | ACADVL | NM_000018.3(ACADVL): c.1375C>T (p.Arg459Trp) | CCGAGATCTTCGCATCTTCYGGA | not provided |
| 118204014 | ACADVL | NM_000018.3(ACADVL): c.1837C>T (p.Arg613Trp) | CCCCAGGCTGCAGCTYGGATCCG, CCCAGGCTGCAGCTYGGATCCGA | Very long chain acyl-CoA dehydrogenase deficiency, not provided |
| 121913568 | ACAN | NM_013227.3(ACAN): c.7141G>A (p.Asp2381Asn) | GAACRACAGGACCATCGAAGGGG, TGAACRACAGGACCATCGAAGGG, CTGAACRACAGGACCATCGAAGG | Spondyloepimetaphyseal dysplasia, Aggrecan type |
| 267606625 | ACAN | NM_013227.3(ACAN): c.7249G>A (p.Val2417Met) | AGGACTGTRTGGTGATGATCTGG | Osteochondritis dissecans |
| 121912703 | ACE | NM_000789.3(ACE): c.3683C>T (p.Pro1228Leu) | CCGCAGTACAACTGGACGCYGAA | Angiotensin i-converting enzyme, benign serum increase |
| 118204093 | ACOX1 | NM_004035.6(ACOX1): c.442C>T (p.Arg148Ter) | CCTTAGGAACTCACCTTYGAGGC | Pseudoneonatal adrenoleukodystrophy |
| 757905943 | ACSF3 | NM_174917.4(ACSF3): c.348G>A (p.Trp116Ter) | GTCATGRATGAGTGGCGGTGTGG | not provided |
| 138680796 | ACSF3 | NM_174917.4(ACSF3): c.1411C>T (p.Arg471Trp) | CCAGTACTGGATCCGAGGCYGGA | Combined malonic and methylmalonic aciduria |
| 140986055 | ACSF3 | NM_174917.4(ACSF3): c.728C>T (p.Pro243Leu) | CCTCCACGTGCTCCYGCTGCACC | Combined malonic and methylmalonic aciduria |
| 367543051 | ACTA1 | NM_001100.3(ACTA1): c.727G>A (p.Glu243Lys) | CTACRAGCTGCCAGACGGGCAGG, AGAGCTACRAGCTGCCAGACGGG | Congenital myopathy with fiber type disproportion |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 267606627 | ACTA1 | NM_001100.3(ACTA1): c.223C>T (p.His75Tyr) | CCTGAAGTACCCTATCGAGYACG | Nemaline myopathy 3 |
| 794728021 | ACTA2 | NM_001613.2(ACTA2): c.116G>A (p.Arg39His) | GACRTCCCAGACATCAGGTGAGG, TGTGGGACRTCCCAGACATCAGG | Thoracic aortic aneurysms and aortic dissections |
| 387906592 | ACTA2 | NM_001613.2(ACTA2): c.536G>A (p.Arg179His) | ATCATGCRTCTGGATCTGGCTGG | Aortic aneurysm, familial thoracic 6, Thoracic aortic aneurysms and aortic dissections, Multisystemic smooth muscle dysfunction syndrome, Moyamoya disease 5 |
| 112901682 | ACTA2 | NM_001141945.1(ACTA2): c.115C>T (p.Arg39Cys) | CCCATCCATTGTGGGABGTCCCA, CCATCCATTGTGGGABGTCCCAG | Aortic aneurysm, familial thoracic 6, Thoracic aortic aneurysms and aortic dissections |
| 397515470 | ACTB | NM_001101.3(ACTB): c.349G>A (p.Glu117Lys) | CAACCGCRAGAAGATGACCCAGG | Baraitser-Winter syndrome 1 |
| 587779770 | ACTB | NM_001101.3(ACTB): c.220G>A (p.Gly74Ser) | GCACRGCATCGTCACCAACTGGG, AGCACRGCATCGTCACCAACTGG | Baraitser-Winter syndrome 1 |
| 587779769 | ACTB | NM_001101.3(ACTB): c.209C>T (p.Pro70Leu) | CCTCACCCTGAAGTACCYCATCG | Baraitser-Winter syndrome 1 |
| 587779774 | ACTB | NM_001101.3(ACTB): c.359C>T (p.Thr120Ile) | CCAACCGCGAGAAGATGAYCCAG, CCGCGAGAAGATGAYCCAGGTGA | Baraitser-Winter syndrome 1 |
| 587779775 | ACTB | NM_001101.3(ACTB): c.446C>T (p.Thr149Ile) | CCTCTGGCCGTACCAYTGGCATC | Baraitser-Winter syndrome 1 |
| 104894546 | ACTG1 | NM_001614.3(ACTG1): c.791C>T (p.Pro264Leu) | CCGGAGGCGCTGTTCCAGCYTTC | Deafness, autosomal dominant 20 |
| 281875325 | ACTG1 | NM_001614.3(ACTG1): c.359C>T (p.Thr120Ile) | CCAACAGAGAGAAGATGAYTCAG | Baraitser-Winter Syndrome 2, not provided |
| 11549190 | ACTG1 | NM_001614.3(ACTG1): c.404C>T (p.Ala135Val) | CCCCGGCCATGTACGTGGYCATC, CCCGGCCATGTACGTGGYCATCC, CCGGCCATGTACGTGGYCATCCA | Baraitser-Winter Syndrome 2, not provided |
| 78001248 | ACTG2 | NM_001615.3(ACTG2): c.532C>T (p.Arg178Cys) | CCTGCCCCATGCCATCATGYGCC, CCCCATGCCATCATGYGCCTGGA, CCCATGCCATCATGYGCCTGGAC | Visceral myopathy |
| 587777385 | ACTG2 | NM_001615.3(ACTG2): c.118C>T (p.Arg40Cys) | CCATTGTGGGCCGCCCCTYGCCAC | Visceral myopathy |
| 387907345 | ACTN1 | NM_001130004.1(ACTN1): c.313G>A (p.Val105Ile) | GGCRTCAAACTGGTGTCCATCGG | Platelet-type bleeding disorder 15 |
| 794728966 | ACTN2 | NM_001103.3(ACTN2): c.2527-1G>A | CCARCCATACATCCTGGCGGAGG, TTCCCARCCATACATCCTGGCGG | Cardiomyopathy |
| 727502886 | ACTN2 | NM_001103.3(ACTN2): c.355G>A (p.Ala119Thr) | GGCRCTGAAGGTGAGAGGTGTGG, CCATTGGCRCTGAAGGTGAGAGG | Dilated cardiomyopathy IAA, Primary familial hypertrophic cardiomyopathy, Familial hypertrophic cardiomyopathy 23 |
| 121434437 | ACVR2B | NM_001106.3(ACVR2B): c.119G>A (p.Arg40His) | CTGGAGCRCACCAACCAGAGCGG | Heterotaxy, visceral, 4, autosomal |
| 28936687 | ACVRL1 | NM_000020.2(ACVRL1): c.632G>A (p.Gly211Asp) | AAGRCCGCTATGGCGAAGTGTGG | Pulmonary arterial hypertension related to hereditary hemorrhagic telangiectasia |
| 28936688 | ACVRL1 | NM_000020.2(ACVRL1): c.1031G>A (p.Cys344Tyr) | CAGTRTTGCATCGCCGACCTGGG, GCAGTRTTGCATCGCCGACCTGG | Hereditary hemorrhagic telangiectasia type 2, Pulmonary arterial hypertension related to hereditary hemorrhagic telangiectasia |
| 28936401 | ACVRL1 | NM_000020.2(ACVRL1): c.1120C>T (p.Arg374Trp) | CCCGAGAGTGGGCACCAAGYGGT, CCGAGAGTGGGCACCAAGYGGTA | Hereditary hemorrhagic telangiectasia type 2, Pulmonary arterial hypertension related to hereditary hemorrhagic telangiectasia |
| 121909288 | ACVRL1 | NM_000020.2(ACVRL1): c.1450C>T (p.Arg484Trp) | CCCGACTCACCGCGCTGYGGATC, CCGACTCACCGCGCTGYGGATCA | Hereditary hemorrhagic telangiectasia type 2, Pulmonary arterial hypertension related to hereditary hemorrhagic telangiectasia |
| 121908716 | ADA | NM_000022.2(ADA): c.632G>A (p.Arg211His) | TCACCRTACTGTCCACGCCGGGG, TTCACCRTACTGTCCACGCCGGG, ATTCACCRTACTGTCCACGCCGG | Severe combined immunodeficiency due to ADA deficiency |
| 121908723 | ADA | NM_000022.2(ADA): c.646G>A (p.Gly216Arg) | CCACGCCRGGGAGGTGGGCTCGG | Severe combined immunodeficiency due to ADA deficiency |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908715 | ADA | NM_000022.2(ADA): c.986C>T (p.Ala329Val) | CCTTTCCAGAACATCAATGYGGC, CCAGAACATCAATGYGGCCAAAT | Severe combined immunodeficiency due to ADA deficiency |
| 121908735 | ADA | NM_000022.2(ADA): c.466C>T (p.Arg156Cys) | CCATCCTGTGCTGCATGYGCCAC | Severe combined immunodeficiency due to ADA deficiency |
| 121908736 | ADA | NM_000022.2(ADA): c.226C>T (p.Arg76Trp) | CCCTTCCCAGGGGCTGCYGGGAG, CCTTCCCAGGGGCTGCYGGGAGG | Severe combined immunodeficiency due to ADA deficiency, Partial adenosine deaminase deficiency |
| 114025668 | ADA | NM_000022.2(ADA): c.643G>A (p.Ala215Thr) | CCGAGCCCACCTCCCCGGYGTGG | Severe combined immunodeficiency due to ADA deficiency, Partial adenosine deaminase deficiency |
| 121434358 | ADAMTS10 | NM_030957.3(ADAMTS10): c.73G>A (p.Ala25Thr) | ACGCACRCCTTCCGGTCTCAAGG | Weill-Marchesani syndrome 1 |
| 121434357 | ADAMTS10 | NM_030957.3(ADAMTS10): c.709C>T (p.Arg237Ter) | CCTGAAGCGATCGGTCAGCYGAG | Weill-Marchesani syndrome 1 |
| 786205077 | ADAMTS13 | NM_139025.4(ADAMTS13): c.414+1G>A | GCCTGAGRTAGGCATGGAGCTGG | Upshaw-Schulman syndrome |
| 281875305 | ADAMTS13 | NM_139025.4(ADAMTS13): c.1523G>A (p.Cys508Tyr) | GGTRTATGCCAAGTGGCCCCCGG | Upshaw-Schulman syndrome, not provided |
| 121908471 | ADAMTS13 | NM_139025.4(ADAMTS13): c.1193G>A (p.Arg398His) | TGCTCCCRCTCCTGCGGAGGAGG | Upshaw-Schulman syndrome |
| 121908474 | ADAMTS13 | NM_139025.4(ADAMTS13): c.3638G>A (p.Cys1213Tyr) | ACTRTGCAGTGGCCATTGGGCGG, CAGACTRTGCAGTGGCCATTGGG, GCAGACTRTGCAGTGGCCATTGG | Upshaw-Schulman syndrome |
| 786205078 | ADAMTS13 | NM_139025.4(ADAMTS13): c.331-1G>A | ACARGGGGCAGAACTGCTTCGGG, CACARGGGGCAGAACTGCTTCGG | Upshaw-Schulman syndrome |
| 11575933 | ADAMTS13 | NM_139025.4(ADAMTS13): c.1423C>T (p.Pro475Ser) | CCACTGGGGTGCTGCTGTAYCAC | Upshaw-Schulman syndrome |
| 121908469 | ADAMTS13 | NM_139025.4(ADAMTS13): c.304C>T (p.Arg102Cys) | CCAGGAGGACACAGAGYGCTATG | Upshaw-Schulman syndrome |
| 121908478 | ADAMTS13 | NM_139025.4(ADAMTS13): c.749C>T (p.Ala250Val) | CCCAGCGGACACGTGATGGYTTC, CCAGCGGACACGTGATGGYTTCG | Upshaw-Schulman syndrome |
| 267606638 | ADAMTS17 | NM_139057.2(ADAMTS17): c.760C>T (p.Gln254Ter) | CCACGGGGCCGAGGCCGCCYAGA | Weill-Marchesani-like syndrome |
| 137853147 | ADAMTS2 | NM_014244.4(ADAMTS2): c.2384G>A (p.Trp795Ter) | GGAGTRGGAGTACAGAGACGAGG | Ehlers-Danlos syndrome type 7, autosomal recessive |
| 137853146 | ADAMTS2 | NM_014244.4(ADAMTS2): c.673C>T (p.Gln225Ter) | CCCTCCTCTCGGGGGCCAYAGG, CCTCCTCTCGGGGGCCAYAGGC, CCTCTCGGGGGCCAYAGGCCCT | Ehlers-Danlos syndrome type 7, autosomal recessive |
| 387907064 | ADAMTSL2 | NM_001145320.1 (ADAMTSL2):c.215G>A (p.Arg72Gln) | AGCRGCACTGCCTGCAGCAGAGG | Acromicric dysplasia |
| 113994121 | ADAMTSL2 | NM_001145320.1 (ADAMTSL2):c.440C>T (p.Pro147Leu) | CCACATCTCCAGCAAACYGTGTG | Acromicric dysplasia |
| 387907065 | ADAMTSL2 | NM_001145320.1 (ADAMTSL2):c.661C>T (p.Arg221Cys) | CCACGTGACGGGCAACTATYGCA | Acromicric dysplasia |
| 368482584 | ADAMTSL4 | NM_019032.5 (ADAMTSL4):c.2008C>T (p.Arg670Ter) | CCAGCTGCGTACTGGAAAYGAGT | Ectopia lentis, isolated autosomal recessive |
| 119468004 | ADCK3 | NM_020247.4(ADCK3): c.1651G>A (p.Glu551Lys) | CTACRAGGTCAAGGTGAGCAGGG, GCTACRAGGTCAAGGTGAGCAGG | Coenzyme Q10 deficiency, primary, 4 |
| 119468009 | ADCK3 | NM_020247.4(ADCK3): c.1645G>A (p.Gly549Ser) | CCTCACCRGCTACGAGGTCAAGG | Coenzyme Q10 deficiency, primary, 4 |
| 119468005 | ADCK3 | NM_020247.4(ADCK3): c.637C>T (p.Arg213Trp) | CCTGTGACGAGGATTGGCYGGCT | Coenzyme Q10 deficiency, primary, 4 |
| 398122981 | ADCK4 | NM_024876.3(ADCK4): c.1027C>T (p.Arg343Trp) | CCTAAGCCAGGACCTGYGGAACC | Nephrotic syndrome, type 9 |
| 587777497 | ADCY1 | NM_021116.2(ADCY1): c.3112C>T (p.Arg1038Ter) | CCCCTACCACTTTGTGTGCYGAG, CCCTACCACTTTGTGTGCYGAGG, CCTACCACTTTGTGTGCYGAGGC | Deafness, autosomal recessive 44 |
| 757156390 | ADCY5 | NM_183357.2(ADCY5): c.1425C>G (p.Ile475Met) | AGCCCTCRATGTCAGCAAACAGG | Multiple congenital anomalies |
| 796065306 | ADCY5 | NM_183357.2(ADCY5): c.2176G>A (p.Ala726Thr) | TTGACRCCAGGAGCATTGATAGG | Dyskinesia, familial, with facial myokymia |
| 587783657 | ADGRG1 | NM_005682.6(ADGRG1): c.1970G>A (p.Trp657Ter) | TCATCTRGTACTGGTCCATGCGG | Polymicrogyria, bilateral frontoparietal |
| 587783660 | ADGRG1 | NM_005682.6(ADGRG1): c.620+1G>A | GCCARTAAGTTTGGCACCTGGGG, AGCCARTAAGTTTGGCACCTGGG, CAGCCARTAAGTTTGGCACCTGG | Polymicrogyria, bilateral frontoparietal |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908464 | ADGRG1 | NM_005682.6(ADGRG1): c.1693C>T (p.Arg565Trp) | CCCGCAGGTGCTGGATCYGGGAC, CCGCAGGTGCTGGATCYGGGACT | Polymicrogyria, bilateral frontoparietal |
| 587783658 | ADGRG1 | NM_005682.6(ADGRG1): c.265C>T (p.His89Tyr) | CCCCAGGGGCCTCTACYACTTCT, CCCAGGGGCCTCTACYACTTCTG, CCAGGGGCCTCTACYACTTCTGC | Polymicrogyria, bilateral frontoparietal |
| 121909762 | ADGRV1 | NM_032119.3(ADGRV1): c.6901C>T (p.Gln2301Ter) | CCCCTGGGGAAACCATTYAAACC, CCTGGGGAAACCATTYAAACCT, CCTGGGGAAACCATTYAAACCTT | Usher syndrome, type 2C |
| 28941471 | ADSL | NM_000026.2(ADSL): c.569G>A (p.Arg190Gln) | TCCRAGATGACCTGCGCTTCCGG | Adenylosuccinate lyase deficiency, not provided |
| 202064195 | ADSL | NM_000026.2(ADSL): c.953C>T (p.Pro318Leu) | CCCTTGTCATGGACCYGCTACAG, CCTTGTCATGGACCYGCTACAGA | not provided |
| 750614500 | ADSL | NM_000026.2(ADSL): c.568C>T (p.Arg190Ter) | CCAGAACTTGAAGCGTGTCYGAG | not provided |
| 756210458 | ADSL | NM_000026.2(ADSL): c.421C>T (p.Arg141Trp) | CCAGAGTGATCTCTYGGCTTGCC | not provided |
| 786205680 | AFF4 | NM_014423.3(AFF4): c.772C>T (p.Arg258Trp) | CCCACTGCCTATGTGYGGCCCAT, CCACTGCCTATGTGYGGCCCATG | CHOPS SYNDROME |
| 727502823 | AFG3L2 | NM_006796.2(AFG3L2): c.1875G>A (p.Met625Ile) | AGGATRTGTATGACTTTAGGTGG, GATAGGATRTGTATGACTTTAGG | Spastic ataxia 5, autosomal recessive |
| 121434412 | AGPS | NM_003659.3(AGPS): c.926C>T (p.Thr309Ile) | CCCTGGAGTTCAGTAYTGTAGGA, CCTGGAGTTCAGTAYTGTAGGAG | Rhizomelic chondrodysplasia punctata type 3 |
| 74315283 | AGT | NM_000029.3(AGT): c.1124G>A (p.Arg375Gln) | TCTCCCCRGTAGGAGCCTCCCGG | Renal dysplasia |
| 121908522 | AGXT | NM_000030.2(AGXT): c.245G>A (p.Gly82Glu) | CTCGGRACACTGTGCCCTGGAGG, TGGCTCGGRACACTGTGCCCTGG | Primary hyperoxaluria, type I |
| 121908523 | AGXT | NM_000030.2(AGXT): c.121G>A (p.Gly41Arg) | GCCRGGGGCTGCAGATGATCGG | Primary hyperoxaluria, type I |
| 121908528 | AGXT | NM_000030.2(AGXT): c.738G>A (p.Trp246Ter) | AAGTGRCTGGCCAACTTCTGGGG, CAAGTGRCTGGCCAACTTCTGGG, TCAAGTGRCTGGCCAACTTCTGG | Primary hyperoxaluria, type I |
| 121908530 | AGXT | NM_000030.2(AGXT): c.466G>A (p.Gly156Arg) | ACCCACRGGGAGTCGTCCACCGG | Primary hyperoxaluria, type I |
| 180177161 | AGXT | NM_000030.2(AGXT): c.1079G>A (p.Arg360Gln) | GTGCTGCRGATCGGCCTGCTGGG, GGTGCTGCRGATCGGCCTGCTGG | Primary hyperoxaluria, type I |
| 180177162 | AGXT | NM_000030.2(AGXT): c.107G>A (p.Arg36His) | CTCRCATCATGGCAGCCGGGGGG, CCTCRCATCATGGCAGCCGGGGG, CTCCTCRCATCATGGCAGCCGGG, CCTCCTCRCATCATGGCAGCCGG | Primary hyperoxaluria, type I |
| 180177163 | AGXT | NM_000030.2(AGXT): c.1102G>A (p.Ala368Thr) | CAATRCCACCCGCGAGAATGTGG | Primary hyperoxaluria, type I |
| 180177170 | AGXT | NM_000030.2(AGXT): c.125G>A (p.Gly42Glu) | CCGGGGRGCTGCAGATGATCGGG, GCCGGGGRGCTGCAGATGATCGG | Primary hyperoxaluria, type I |
| 180177177 | AGXT | NM_000030.2(AGXT): c.166-1G>A | GCARATCATGGACGAGATCAAGG | Primary hyperoxaluria, type I |
| 180177196 | AGXT | NM_000030.2(AGXT): c.308G>A (p.Gly103Glu) | TTGRGGCCAATGGCATTTGGGGG, GTTGRGGCCAATGGCATTTGGGG, GGTTGRGGCCAATGGCATTTGGG, TGGTTGRGGCCAATGGCATTTGG | Primary hyperoxaluria, type I |
| 180177198 | AGXT | NM_000030.2(AGXT): c.323G>A (p.Trp108Ter) | CATTTRGGGGCAGCGAGCCGTGG | Primary hyperoxaluria, type I |
| 180177231 | AGXT | NM_000030.2(AGXT): c.518G>A (p.Cys173Tyr) | AACTCTRCCACAGGTGAGCCTGG | Primary hyperoxaluria, type I |
| 180177235 | AGXT | NM_000030.2(AGXT): c.533G>A (p.Cys178Tyr) | GTACAAGTRCCTGCTCCTGGTGG | Primary hyperoxaluria, type I |
| 180177236 | AGXT | NM_000030.2(AGXT): c.547G>A (p.Asp183Asn) | GTGRATTCGGTGGCATCCCTGGG, GGTGRATTCGGTGGCATCCCTGG | Primary hyperoxaluria, type I |
| 61729604 | AGXT | NM_000030.2(AGXT): c.866G>A (p.Arg289His) | CAGCTGGCRCCAGCACCGCGAGG | Primary hyperoxaluria, type I, not provided |
| 180177210 | AGXT | NM_000030.2(AGXT): c.864C>T (p.Arg122Ter) | CCTGCACCCAGGAGCCYGAGTGC | Primary hyperoxaluria, type I |
| 180177279 | AGXT | NM_000030.2(AGXT): c.844C>T (p.Gln282Ter) | CCTGGCCCTCATTGCGGAAYAGG, CCCTCATTGCGGAAYAGGTGCAT | Primary hyperoxaluria, type I |
| 180177296 | AGXT | NM_000030.2(AGXT): c.922C>T (p.Gln308Ter) | CCTGCAGGCACTGGGGCTGYAGC | Primary hyperoxaluria, type I |
| 104894325 | AICDA | NM_020661.2(AICDA): c.203G>A (p.Trp68Ter) | TCGGACTRGGACCTAGACCCTGG | Immunodeficiency with hyper IgM type 2 |
| 104894324 | AICDA | NM_020661.2(AICDA): c.70C>T (p.Arg24Trp) | CCGCTGGGCTAAGGGTYGGCGTG | Immunodeficiency with hyper IgM type 2 |
| 104894190 | AIP | NM_003977.3(AIP): c.911G>A (p.Arg304Gln) | GAGCCRAGAGCTGCAGGCCCTGG | Pituitary dependent hypercortisolism |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894194 | AIP | NM_003977.3(AIP): c.40C>T (p.Gln14Ter) | CCGGGAGGACGGGATCYAAAAAC | Somatotroph adenoma, Prolactinoma, familial, Pituitary adenoma predisposition |
| 267606541 | AIP | NM_003977.3(AIP): c.241C>T (p.Arg81Ter) | CCATCGTGTGCACCATGYGAGAA | Somatotroph adenoma |
| 62637014 | AIPL1 | NM_014336.4(AIPL1): c.834G>A (p.Trp278Ter) | GTGRAATGAGGCCGAGGCCAAGG | Leber congenital amaurosis 4, not provided |
| 61757484 | AIPL1 | NM_014336.4(AIPL1): c.1126C>T (p.Pro376Ser) | GACGRGGGTGGCTCTGTGGCTGG, TGGGGACGRGGGTGGCTCTGTGG CCCCTGCAGCCCCGCGCACYTGG, | Leber congenital amaurosis 4, not specified, not provided |
| 142326926 | AIPL1 | NM_014336.4(AIPL1): c.784G>A (p.Gly262Ser) | CCCTGCAGCCCCGCGCACYTGGG, CCTGCAGCCCCGCGCACYTGGGT | Leber congenital amaurosis 4, not provided |
| 137853204 | AK1 | NM_000476.2(AK1): c.118G>A (p.Gly40Arg) | TCTCCACCRGGGACCTCCTGCGG | Adenylate kinase deficiency, hemolytic anemia due to |
| 137853205 | AK1 | NM_000476.2(AK1): c.190G>A (p.Gly64Arg) | GAAGRGGCAGCTGGTTCCACTGG | Adenylate kinase deficiency, hemolytic anemia due to |
| 104894101 | AK1 | NM_000476.2(AK1): c.382C>T (p.Arg128Trp) | CCCTGAGACCATGACCCAGYGGC, CCTGAGACCATGACCCAGYGGCT | Adenylate kinase deficiency, hemolytic anemia due to |
| 121918343 | AKR1D1 | NM_005989.3(AKR1D1): c.316C>T (p.Leu106Phe) | CCCAACCCTGGAGAGGACAYTCA, CCAACCCTGGAGAGGACAYTCAG, CCCTGGAGAGGACAYTCAGGGTC | Bile acid synthesis defect, congenital, 2 |
| 121434592 | AKT1 | NM_005163.2(AKT1): c.49G>A (p.Glu17Lys) | TAGGGRAGTACATCAAGACCTGG | Proteus syndrome, Carcinoma of colon, Breast adenocarcinoma, Neoplasm of ovary |
| 121434593 | AKT2 | NM_001626.5(AKT2): c.821G>A (p.Arg274His) | TACCRCGACATCAAGGTTAGTGG | Diabetes mellitus type 2 |
| 387906659 | AKT2 | NM_001626.5(AKT2): c.49G>A (p.Glu17Lys) | CAGGTRAATACATCAAGACCTGG | |
| 397514606 | AKT3 | NM_181690.2(AKT3): c.49G>A (p.Glu17Lys) | TAGGARAATATATAAAAAACTGG | Megalencephaly-polymicrogyria-polydactyly-hydrocephalus syndrome 2 |
| 121912981 | ALAD | NM_000031.5(ALAD): c.823G>A (p.Val275Met) | CTCGCCRTGTACCACGTCTCTGG | Porphobilinogen synthase deficiency |
| 121912983 | ALAD | NM_000031.5(ALAD): c.820G>A (p.Ala274Thr) | CTCRCCGTGTACCACGTCTCTGG | Porphobilinogen synthase deficiency |
| 749066913 | ALAD | NM_000031.5(ALAD): c.165-11C>T | GGTRTGGGTAGAGGGGTTGAAGG | Porphobilinogen synthase deficiency |
| 121912982 | ALAD | NM_000031.5(ALAD): c.718C>T (p.Arg240Trp) | CCCTCATCCCTTAGGACYGGGAT, CCTCATCCCTTAGGACYGGGATG | Porphobilinogen synthase deficiency |
| 137852302 | ALAS2 | NM_000032.4(ALAS2): c.871G>A (p.Gly291Ser) | ATCCAARGTATCCGTAACAGTGG | Hereditary sideroblastic anemia |
| 386834230 | ALDH1A3 | NM_000693.3(ALDH1A3): c.211G>A (p.Val71Met) | CGACRTGGACAAGGCTGTGGAGG, GCCCGACRTGGACAAGGCTGTGG | not provided |
| 397514652 | ALDH1A3 | NM_000693.3(ALDH1A3): c.265C>T (p.Arg89Cys) | CCAGAGGGGCTCGCCATGGYGCC | Microphthalmia, isolated 8 |
| 28939378 | ALG1 | NM_019109.4(ALG1): c.773C>T (p.Ser258Leu) | CCCAGTCACGGAGCGGTYGGCCT, CCAGTCACGGAGCGGTYGGCCTT | Congenital disorder of glycosylation type 1K, not provided |
| 121907933 | ALG12 | NM_024105.3(ALG12): c.301G>A (p.Gly101Arg) | GTTAGARGAGTGCTTGGACTCGG | Congenital disorder of glycosylation type 1G |
| 121907931 | ALG12 | NM_024105.3(ALG12): c.200C>T (p.Thr67Met) | CCCGGAGTCGTCCCCAGGAYGTT, CCGGAGTCGTCCCCAGGAYGTTC | Congenital disorder of glycosylation type 1G |
| 367570129 | ALG14 | NM_144988.3(ALG14): c.310C>T (p.Arg104Ter) | AATTCRGTGAATGTAGTATTTGG | Myasthenic syndrome, congenital, without tubular aggregates |
| 28940588 | ALG3 | NM_005787.5(ALG3): c.353G>A (p.Gly118Asp) | CCGAGRCACTGACATCCGCATGG | Congenital disorder of glycosylation type 1D |
| 387906273 | ALG3 | NM_005787.5(ALG3): c.165C>T (p.Gly55=) | CCTGGCGGAGGTGGGYATCACCT | Congenital disorder of glycosylation type 1D |
| 121908294 | ALG8 | NM_024079.4(ALG8): c.824G>A (p.Gly275Asp) | GGGRCCTCTGTCATGCATATTGG | Congenital disorder of glycosylation type 1H |
| 397514527 | ALOX12B | NM_001139.2(ALOX12B): c.1294C>T (p.Arg432Ter) | CCTCATCCCCCATACCYGATACA | Autosomal recessive congenital ichthyosis 2 |
| 397514531 | ALOX12B | NM_001139.2(ALOX12B): c.1207C>T (p.His403Tyr) | CCCACCTGCTGGAGACAYACCTC, CCACCTGCTGGAGACAYACCTCA | Autosomal recessive congenital ichthyosis 2 |
| 121434233 | ALOXE3 | NM_001165960.1 (ALOXE3):c.1096C>T (p.Arg366Ter) | CCTTGGGAATGAAGCTTYGAGGG | Autosomal recessive congenital ichthyosis 3 |
| 749544042 | ALPL | NM_000478.4(ALPL): c.648+1G>A | ACATTGACRTGAGTGCTCGGGGG | |
| 121918007 | ALPL | NM_000478.4(ALPL): c.571G>A (p.Glu191Lys) | AGACAACRAGATGCCCCCTGAGG | Childhood hypophosphatasia, Infantile hypophosphatasia, Adult hypophosphatasia |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918009 | ALPL | NM_000478.4(ALPL): c.1001G>A (p.Gly334Asp) | AAGGAGRCAGAATTGACCACGGG, CAAGGAGRCAGAATTGACCACGG | Infantile hypophosphatasia |
| 121918013 | ALPL | NM_000478.4(ALPL): c.346G>A (p.Ala116Thr) | CGCCACCRCCTACCTGTGGGG, CCGCCACCRCCTACCTGTGTGGG | Childhood hypophosphatasia, Infantile hypophosphatasia, Adult hypophosphatasia, Odontohypophosphatasia |
| 121918019 | ALPL | NM_000478.4(ALPL): c.526G>A (p.Ala176Thr) | CAGCRCCGCCTACGCCCACTCGG | Childhood hypophosphatasia, Infantile hypophosphatasia |
| 121918015 | ALPL | NM_000478.4(ALPL): c.323C>T (p.Pro108Leu) | CCAATGCCCAGGTCCYTGACAGC | Odontohypophosphatasia |
| 121918020 | ALPL | NM_000478.4(ALPL): c.814C>T (p.Arg272Cys) | CCCACTTCATCTGGAACYGCACG, CCACTTCATCTGGAACYGCACGG | Childhood hypophosphatasia, Infantile hypophosphatasia |
| 1130335 | ALPP | NM_001632.3(ALPP): c.74C=(p.Pro25=) | CCCTGGGCATCATCCYAGGTAAT, CCTGGGCATCATCCYAGGTAATG | |
| 587776684 | ALX1 | NM_006982.2(ALX1): c.531+1G>A | TCCAGRTAGGAGCCAAAAAGAGG | Frontonasal dysplasia 3 |
| 121908168 | ALX3 | NM_006492.2(ALX3): c.547C>T (p.Arg183Trp) | CCTGATGTGTATGCCYGGGAGCA | Frontonasal dysplasia 1 |
| 387907269 | AMER1 | NM_152424.3(AMER1): c.811C>T (p.Gln271Ter) | CCTCAGCACATGTGYAACCCAAG | Osteopathia striata with cranial sclerosis |
| 121912682 | AMPD1 | NM_000036.2(AMPD1): c.1373G>A (p.Arg458His) | GAGCCCRCCTGTCCATCTATGG | Muscle AMP deaminase deficiency, not provided |
| 121964981 | AMT | NM_000481.3(AMT): c.806G>A (p.Gly269Asp) | AGGCAGRCCTCTGCCTGTATGGG, GAGGCAGRCCTCTGCCTGTATGG | Non-ketotic hyperglycinemia |
| 36210415 | ANK2 | NM_001127493.1(ANK2): c.1360G>A (p.Gly454Arg) | CCGAGCCRGGCAGGTGGAAGTGG | Torsades de pointes |
| 1800497 | ANKK1 | NM_178510.1(ANKK1): c.2137G>A (p.Glu713Lys) | CCAGCTGGGCGCCTGCCTYGACC | Dopamine receptor d2, reduced brain density of |
| 137852512 | ANOS1 | NM_000216.2(ANOS1): c.711G>A (p.Trp237Ter) | TCACTGRCAGACAGTGGCCCAGG | Kallmann syndrome 1 |
| 137852514 | ANOS1 | NM_000216.2(ANOS1): c.774G>A (p.Trp258Ter) | CCGATGRTACCAGTTTCGAGTGG | Kallmann syndrome 1 |
| 137852516 | ANOS1 | NM_000216.2(ANOS1): c.84C>T (p.Arg262Ter) | CCGATGGTACCAGTTTYGAGTGG | Kallmann syndrome 1 |
| 137852517 | ANOS1 | NM_000216.2(ANOS1): c.1187C>T (p.Ser396Leu) | CCCTTCACTTCACATYGACACAT, CCTTCACTTCACATYGACACATG | Kallmann syndrome 1 |
| 397514700 | ANTXR1 | NM_032208.2(ANTXR1): c.505C>T (p.Arg169Ter) | CCCAGGCTAATAGGTCTYGAGAT, CCAGGCTAATAGGTCTYGAGATC | Odontotrichomelic syndrome |
| 587776739 | AP1S2 | NM_003916.4(AP1S2): c.288+5G>A | CCTAAAATAAAATACTAYTCACA | Mental retardation X-linked syndromic 5 |
| 397514498 | AP2S1 | NM_004069.4(AP2S1): c.43C>T (p.Arg15Cys) | CCGGGCAGGCAAGACGYGCCTGG | Hypocalciuric hypercalcemia, familial, type 3 |
| 730882249 | AP4M1 | NM_004722.3(AP4M1): c.952C>T (p.Arg318Ter) | CCAGGTTTATCTAAAGTTYGTGAT | Microcephaly, Hypoplasia of the corpus callosum, Spastic paraplegia 50, autosomal recessive, Global developmental delay, CNS hypomyelination, Brain atrophy |
| 587781392 | APC | NM_000038.5(APC): c.637C>T (p.Arg213Ter) | CCAGGATATGGAAAAAYGAGCAC | Hereditary cancer-predisposing syndrome, not provided |
| 121913327 | APC | NM_000038.5(APC): c.4012C>T (p.Gln1338Ter) | CCAAATCCAGCAGACTGYAGGGT | Familial adenomatous polyposis 1, Carcinoma of colon |
| 587783029 | APC | NM_000038.5(APC): c.3286C>T (p.Gln1096Ter) | CCAACCACATTTTGGACAGYAGG, CCACATTTTGGACAGYAGGAATG | Familial adenomatous polyposis 1, not provided |
| 121909576 | APOA4 | NM_000482.3(APOA4): c.748G>A (p.Glu250Lys) | ACGCCRAGGAGCTCAAGGCCAGG | |
| 121918390 | APOB | NM_000384.2(APOB): c.7564C>T (p.Arg2522Ter) | CCTAGAAGATACACGAGACYGAA | Hypobetalipoproteinemia, familial, associated with apob32 |
| 138326449 | APOC3 | NM_000040.1(APOC3): c.55+1G>A | TCTGCCCRTAAGCACTTGGTGGG, CTCTGCCCRTAAGCACTTGGTGG | Coronary heart disease, Hyperalphalipoproteinemia 2 |
| 28931577 | APOE | NM_000041.3(APOE): c.349G>A (p.Ala117Thr) | CAGRCGGCGCAGGCCCGGCTGGG, GCAGRCGGCGCAGGCCCGGCTGG, AGCTGCAGRCGGCGCAGGCCCGG | |
| 121918398 | APOE | NM_000041.3(APOE): c.875G>A (p.Arg292His) | GCAGRCCAGTGGGCCGGGCTGG | |
| 267606664 | APOE | NM_000041.3(APOE): c.434G>A (p.Gly145Asp) | CATGCTCGRCCAGAGCACCGAGG | |
| 7412 | APOE | NM_000041.2(APOE): c.526C>T (p.Arg176Cys) | CCGATGACCTGCAGAAGYGCCTG | Familial type 3 hyperlipoproteinemia |
| 769455 | APOE | NM_000041.3(APOE): c.487C>T (p.Arg163Cys) | CCCACCTGCGCAAGCTGYGTAAG, CCACCTGCGCAAGCTGYGTAAGC | Familial type 3 hyperlipoproteinemia |
| 387906567 | APOE | NM_000041.3(APOE): c.478C>T (p.Arg160Cys) | CCTCGCCTCCCACCTGYGCAAGC | Familial type 3 hyperlipoproteinemia |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 63749810 | APP | NM_000484.3(APP): c.2080G>A (p.Asp694Asn) | GAARATGTGGGTTCAAACAAAGG | Cerebral amyloid angiopathy, APP-related, not provided |
| 63750734 | APP | NM_000484.3(APP): c.2143G>A (p.Val715Met) | GACARTGATCGTCATCACCTTGG | Alzheimer disease, type 1, not provided |
| 104894507 | APRT | NM_000485.2(APRT): c.294G>A (p.Trp98Ter) | TCTGTGRGCCTCCTATTCCCTGG | Adenine phosphoribosyltransferase deficiency |
| 121908131 | APTX | NM_175073.2(APTX): c.617C>T (p.Pro206Leu) | CCATTGGCTGGTCTTACYGTGGA | Adult onset ataxia with oculomotor apraxia |
| 104894004 | AQP1 | NM_198098.2(AQP1): c.113C>T (p.Pro38Leu) | CCCTGGGCTTCAAATACCYGGTG, CCTGGGCTTCAAATACCYGGTGG | |
| 368292687 | AQP5 | NM_001651.3(AQP5): c.562C>T (p.Arg188Cys) | CCATGAACCCAGCCYGCTCTTTT | Diffuse palmoplantar keratoderma, Bothnian type |
| 104894742 | AR | NM_000044.3(AR): c.4G>A (p.Glu2Lys) | ATGRAAGTGCAGTTAGGGCTGGG, GATGRAAGTGCAGTTAGGGCTGG, CAAGGATGRAAGTGCAGTTAGGG | Reifenstein syndrome |
| 137852563 | AR | NM_000044.3(AR): c.2157G>A (p.Trp719Ter) | AAGTGRGCCAAGGCCTTGCCTGG | |
| 137852571 | AR | NM_000044.3 (AR): c.2191G>A (p.Val731Met) | CTTACACRTGGACGACCAGATGG | Malignant tumor of prostate |
| 137852572 | AR | NM_000044.3(AR): c.2324G>A (p.Arg775His) | GGTACCRCATGCACAAGTCCCGG | |
| 137852583 | AR | NM_000044.3(AR): c.2164G>A (p.Ala722Thr) | GGCCAAGRCCTTGCCTGGTAAGG | Malignant tumor of prostate |
| 137852588 | AR | NM_000044.3(AR): c.1645C>T (p.Pro549Ser) | CCAGGGACCATGTTTTGYCCATT | Hypospadias 1, X-linked |
| 28940281 | ARHGEF10 | NM_014629.3(ARHGEF10): c.995C>T (p.Thr332Ile) | CCGCGAAGGACGGCAYCAAGGAC | Slowed nerve conduction velocity, autosomal dominant |
| 587779745 | ARID1B | NM_020732.3(ARID1B): c.4102C>T (p.Gln1368Ter) | CCAGCCCGGCCTGTACCCAYAGC, CCCGGCCTGTACCCAYAGCAGCC, CCGGCCTGTACCCAYAGCAGCCG | Coffin Siris/Intellectual Disability |
| 387907140 | ARID1B | NM_020732.3(ARID1B): c.3919C>T (p.Gln1307Ter) | CCAACAGCAGCATGYAGGACAT, CCAACAGCAGCATGYAGGACATG | Mental retardation, autosomal dominant 12 |
| 387907141 | ARID1B | NM_020732.3(ARID1B): c.3304C>T (p.Arg1102Ter) | CCCCTGGACCTGTTCYGACTCTA, CCCTGGACCTGTTCYGACTCTAC | Mental retardation, autosomal dominant 12 |
| 369721476 | ARMC5 | NM_001288767.1(ARMC5): c.1084C>T (p.Arg362Ter) | CCCTCCTGGAACTCAGCYGAGGC, CCTCCTGGAACTCAGCYGAGGCT | Acth-independent macronodular adrenal hyperplasia 2 |
| 199476366 | ARSA | NM_000487.5(ARSA): c.737G>A (p.Arg246His) | TTCAGGCCRCGGGCCATTTGGGG | Metachromatic leukodystrophy, not provided |
| 74315461 | ARSA | NM_000487.5(ARSA): c.370G>A (p.Gly124Ser) | GGCCRGCAAGTGGCACCTTGGGG, TGGCCRGCAAGTGGCACCTTGGG, ATGGCCRGCAAGTGGCACCTTGG | Metachromatic leukodystrophy, not provided |
| 80338815 | ARSA | NM_000487.5(ARSA): c.465+1G>A | CGACCAGRTAGGAACCACCCGGG, ACGACCAGRTAGGAACCACCCGG | Metachromatic leukodystrophy, Metachromatic leukodystrophy, juvenile type, Metachromatic leukodystrophy, adult type |
| 80338820 | ARSA | NM_000487.5(ARSA): c.1210+1G>A | CCCAGGRTAACCCCTCCCCGTGG | Metachromatic leukodystrophy, Metachromatic leukodystrophy, juvenile type |
| 74315458 | ARSA | NM_000487.5(ARSA): c.257G>A (p.Arg86Gln) | GTTCRGATGGGCATGTACCCTGG | Metachromatic leukodystrophy |
| 74315483 | ARSA | NM_000487.5(ARSA): c.763G>A (p.Glu255Lys) | ATGRAGCTGGATGCAGCTGTGGG, GATGRAGCTGGATGCAGCTGTGG | Metachromatic leukodystrophy, late infantile |
| 74315456 | ARSA | NM_000487.5(ARSA): c.293C>T (p.Ser98Phe) | CCTGGTGCCCAGCTYCCGGGGGG | Metachromatic leukodystrophy, late infantile |
| 74315462 | ARSA | NM_000487.5(ARSA): c.413C>T (p.Pro138Leu) | CCTGAGGGGGCCTTCCTGCYCCC | |
| 398123418 | ARSA | NM_000487.5(ARSA): c.986C>T (p.Thr329Ile) | CCTGCCCCAGGCGTGAYCCACG | Metachromatic leukodystrophy |
| 74315468 | ARSA | NM_000487.5(ARSA): c.677C>T (p.Ala226Val) | CCCTTCTTCCTGTACTATGYCTC, CCTTCTTCCTGTACTATGYCTCT | Metachromatic leukodystrophy |
| 74315473 | ARSA | NM_000487.5(ARSA): c.868C>T (p.Arg290Cys) | CCCAGACCTGAGACCATGYGTAT, CCAGACCTGAGACCATGYGTATG | Metachromatic leukodystrophy |
| 74315481 | ARSA | NM_000487.5(ARSA): c.1232C>T (p.Thr411Ile) | CCCACAGTGATACCAYTGCAGAC, CCACAGTGATACCAYTGCAGACC | Metachromatic leukodystrophy |
| 118203941 | ARSB | NM_000046.3(ARSB): c.1214G>A (p.Cys405Tyr) | CCCAGRTCCCAGGAACAGCATGG | Mucopolysaccharidosis type VI, MUCOPOLYSACCHARIDOSIS, TYPE VI, SEVERE |
| 118203942 | ARSB | NM_000046.3(ARSB): c.284G>A (p.Arg95Gln) | TCGCRGAGCCAGCTGCTCACTGG | Mucopolysaccharidosis type VI, not provided |
| 122460155 | ARSE | NM_000047.2(ARSE): c.1475G>A (p.Cys492Tyr) | CGGTGCCTRCTATGGAAGAAAGG | Chondrodysplasia punctata 1, X-linked recessive |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28935474 | ARSE | NM_000047.2(ARSE): c.1732C>T (p.Pro578Ser) | CCCTGCTGTGGCCCGTTCYCCCT, CCTGCTGTGGCCCGTTCYCCCTC | Chondrodysplasia punctata 1, X-linked recessive |
| 587783096 | ARX | NM_139058.2(ARX): c.1141G>A (p.Ala381Thr) | TCGGRCCAAGTGGCGCAAGCGGG, GTCGGRCCAAGTGGCGCAAGCGG | not provided |
| 104894740 | ARX | NM_139058.2(ARX): c.1117C>T (p.Gln373Ter) | CCGAGGCCCGAGTCYAGGTGAGC | Lissencephaly 2, X-linked |
| 104894743 | ARX | NM_139058.2(ARX): c.1058C>T (p.Pro353Leu) | CCAGAAGACGCACTACCYGGACG | Epileptic encephalopathy, early infantile, 1 |
| 587783189 | ARX | NM_139058.2(ARX): c.1414C>T (p.Arg472Ter) | CCTCGGAGCGGCAGTGTTCYGAC | Lissencephaly 2, X-linked |
| 145873635 | ASAH1 | NM_004315.4(ASAH1): c.173C>T (p.Thr58Met) | ACTCACRTTGGTCCTGAAGGAGG | Jankovic Rivera syndrome |
| 104886478 | ASB10 | NM_080871.3(ASB10): c.765C>T (p.Thr255=) | CCGATGCCGAGGCCACCACYGCC | Glaucoma 1, open angle, F |
| 145138923 | ASL | NM_000048.3(ASL): c.35G>A (p.Arg12Gln) | TGGCCRGTTTGTGGGTGCAGTGG | Argininosuccinate lyase deficiency, not provided |
| 142637046 | ASL | NM_000048.3(ASL): c.446+1G>A | GCAGAGGCRTGAGTCCTACAGGG | not provided |
| 28940286 | ASL | NM_001024943.1(ASL): c.1153C>T (p.Arg385Cys) | CCCAGATGCCATTCYGCCAGGCC | Argininosuccinate lyase deficiency |
| 398123126 | ASL | NM_000048.3(ASL): c.544C>T (p.Arg182Ter) | CCACGCCGTGGCACTGACCYGAG, CCGTGGCACTGACCYGAGACTCT | Argininosuccinate lyase deficiency, not provided |
| 374304304 | ASL | NM_000048.3(ASL): c.280C>T (p.Arg94Cys) | CCACACAGCCAATGAGYGCCGCC | Argininosuccinate lyase deficiency, not provided |
| 398122974 | ASNS | NM_183356.3(ASNS): c.1648C>T (p.Arg550Cys) | CCACTGACCCTTCTGCCYGCACG | Asparagine synthetase deficiency, Abnormality of neuronal migration |
| 199422154 | ASPM | NM_018136.4(ASPM): c.3082G>A (p.Gly1028Arg) | GCATRGTAAAAACTGAGTAGAGG | Primary autosomal recessive microcephaly 5 |
| 587783287 | ASPM | NM_018136.4(ASPM): c.9091C>T (p.Arg3031Ter) | CCTTATAGAGACATYGAGCTGCT | Primary autosomal recessive microcephaly 5 |
| 587783227 | ASPM | NM_018136.4(ASPM): c.2791C>T (p.Arg931Ter) | CCTTTTGGCTTTTTCAYGAGATT | Primary autosomal recessive microcephaly 5 |
| 587783275 | ASPM | NM_018136.4(ASPM): c.8017C>T (p.Gln2673Ter) | CCAAGCAGTTATTTGTATAYAGT | Primary autosomal recessive microcephaly 5 |
| 199422148 | ASPM | NM_018136.4(ASPM): c.1990C>T (p.Gln664Ter) | CCCATTATCGCTGTGGCAYAGTC, CCATTATCGCTGTGGCAYAGTCC | Primary autosomal recessive microcephaly 5 |
| 199422175 | ASPM | NM_018136.4(ASPM): c.7894C>T (p.Gln2632Ter) | CCAGGCTGCCATTATTATTYAGA | Primary autosomal recessive microcephaly 5 |
| 137852996 | ASPM | NM_018136.4(ASPM): c.349C>T (p.Arg117Ter) | CCACTCAAAGAAGGCYGAGTAAG | Primary autosomal recessive microcephaly 5 |
| 121908637 | ASS1 | NM_000050.4(ASS1): c.470G>A (p.Arg157His) | CAAGGGCCRCAATGACCTGATGG | Citrullinemia type I, not provided |
| 121908639 | ASS1 | NM_000050.4(ASS1): c.970G>A (p.Gly324Ser) | TACCRGTGCGTAAGACTCTATGG | Citrullinemia type I, not provided |
| 777828000 | ASS1 | NM_000050.4(ASS1): c.571G>A (p.Glu191Lys) | CAGCTACRAGGCTGGAATCCTGG | Citrullinemia type I |
| 398123131 | ASS1 | NM_000050.4(ASS1): c.794G>A (p.Arg265His) | CGTGGGCCRTATTGACATCGTGG | Citrullinemia type I, not provided |
| 786204537 | ASS1 | NM_000050.4(ASS1): c.1030C>T (p.Arg344Ter) | CCAAGTCCCAGGAGYGAGTGGAA | Citrullinemia type I, not provided |
| 138350285 | ASS1 | NM_000050.4(ASS1): c.-4C>T | CCTCGACTCCCGCCAGAYGCTAT | not provided |
| 121908640 | ASS1 | NM_000050.4(ASS1): c.1087C>T (p.Arg363Trp) | CCAGGTGTACATCCTCGGCYGGG | Citrullinemia type I, not provided |
| 121908642 | ASS1 | NM_000050.4(ASS1): c.910C>T (p.Arg304Trp) | CCTTCACCATGGACYGGGAAGTG | Citrullinemia type I |
| 373145711 | ASXL1 | NM_015338.5(ASXL1): c.1210C>T (p.Arg404Ter) | CCAGCCACCCGACAGYGAGATGG | C-like syndrome |
| 387907077 | ASXL1 | NM_015338.5(ASXL1): c.2773C>T (p.Gln925Ter) | CCATCTGTTGAGCCCYAGGTTGG | C-like syndrome |
| 587777061 | ASXL3 | NM_030632.1(ASXL3): c.1210C>T (p.Gln404Ter) | CCTTGGCAGAACAAYAGCCAAAA | Bainbridge-Ropers syndrome |
| 761357250 | ATF6 | NM_007348.3(ATF6): c.970C>T (p.Arg324Cys) | CCGCTTGTCAGTCTYGCAAGAAG | Achromatopsia 7 |
| 119476046 | ATL1 | NM_015915.4(ATL1): c.715C>T (p.Arg239Cys) | CCAAATTCTTGGAAAAAYGCCTC | Spastic paraplegia 3 |
| 137852657 | ATL1 | NM_015915.4(ATL1): c.467C>T (p.Thr156Ile) | CCTTTGATAGTCAGTCAAYTTTG | Spastic paraplegia 3 |
| 587779818 | ATM | NM_000051.3(ATM): c.170G>A (p.Trp57Ter) | TGAATTRGGATGCTGTTTTTAGG | Ataxia-telangiectasia syndrome, Hereditary cancer-predisposing syndrome |
| 786201957 | ATM | NM_000051.3(ATM): c.3349C>T (p.Gln1117Ter) | CCTTTGAAGCTTCAGYAAACAGC | Hereditary cancer-predisposing syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199624796 | ATP13A2 | NM_022089.3(ATP13A2): c.490C>T (p.Arg164Trp) | ATACCRCAGCACCCGCTTCTGGG, AATACCRCAGCACCCGCTTCTGG | Parkinson disease 9 |
| 121918616 | ATP1A2 | NM_000702.3(ATP1A2): c.1643G>A (p.Arg548His) | GGGAGCRTGTGCTGGGTGAGAGG | Migraine, familial basilar |
| 796052276 | ATP1A2 | NM_000702.3(ATP1A2): c.1091C>T (p.Thr364Met) | CCTGGAGGCGGTGGAGAYGCTGG | not provided |
| 121918615 | ATP1A2 | NM_000702.3(ATP1A2): c.2936C>T (p.Pro979Leu) | CCCTCCGCATGTACCYGCTCAAG, CCTCCGCATGTACCYGCTCAAGT | Familial hemiplegic migraine type 2 |
| 121918620 | ATP1A2 | NM_000702.3(ATP1A2): c.1127C>T (p.Thr376Met) | CCATCTGCTCGGACAAGAYGGGC | Familial hemiplegic migraine type 2 |
| 80356534 | ATP1A3 | NM_152296.4(ATP1A3): c.1838C>T (p.Thr613Met) | CCGGCGATCACCCCATCAYGGCC | Dystonia 12 |
| 121918113 | ATP2A1 | NM_004320.4(ATP2A1): c.592C>T (p.Arg198Ter) | CCCGTTCCTGACCCCYGAGCTGT, CCGTTCCTGACCCCYGAGCTGTC | Brody myopathy |
| 121918115 | ATP2A1 | NM_004320.4(ATP2A1): c.2366C>T (p.Pro789Leu) | CCTGAGGCCCTGATCCYGGTGCA | Brody myopathy |
| 121912736 | ATP2A2 | NM_001681.3(ATP2A2): c.2305G>A (p.Gly769Arg) | CGTCRGGGAAGTTGTCTGGTAGG, CCAACGTCRGGGAAGTTGTCTGG | Darier disease, segmental |
| 28929478 | ATP2A2 | NM_001681.3(ATP2A2): c.68G>A (p.Gly23Glu) | TACGGRGCTGAGCCTGGAACAGG | Keratosis follicularis |
| 137853012 | ATP2C1 | NM_001001486.1(ATP2C1): c.910G>A (p.Ala304Thr) | GCTGTARCAGCAATTCCTGAAGG | Familial benign pemphigus |
| 121918521 | ATP6AP2 | NM_005765.2(ATP6AP2): c.321C>T (p.Asp107=) | CCTTTTAGTCTTGAYAGTGTTGC | Mental retardation, X-linked, syndromic, Hedera type |
| 374480381 | A2ATP6V0 | NM_012463.3(ATP6V0A2): c.1514+1G>A | GGAARTAAGTGTCCCATAGCTGG | Cutis laxa with osteodystrophy, not provided |
| 28939081 | ATP6V0A4 | NM_020632.2(ATP6V0A4): c.2420G>A (p.Arg807Gln) | TGCRACTGCACTGGTAAGGATGG, GCCCTGCRACTGCACTGGTAAGG | Renal tubular acidosis, distal, autosomal recessive, with late-onset sensorineural hearing loss |
| 121908367 | ATP6V0A4 | NM_020632.2(ATP6V0A4): c.2257C>T (p.Gln753Ter) | CCTCAGCCTGGCTCATGCAYGTG | Renal tubular acidosis, distal, autosomal recessive |
| 121908368 | ATP6V0A4 | NM_020632.2(ATP6V0A4): c.1571C>T (p.Pro524Leu) | CCCGTTTGGGATTGATCYGGTAA, CCGTTTGGGATTGATCYGGTAAT | Renal tubular acidosis, distal, autosomal recessive |
| 121964881 | ATP6V1B1 | NM_001692.3(ATP6V1B1): c.232G>A (p.Gly78Arg) | GAGCRGGCAGGTGCTTGAGGTGG, GAGGAGCRGGCAGGTGCTTGAGG | |
| 794729667 | ATP6V1B2 | NM_001693.3(ATP6V1B2): c.1516C>T (p.Arg506Ter) | CCTCAGCGAATTTTACCCTYGAG | Zimmermann-Laband syndrome 2 |
| 267606673 | ATP7A | NM_000052.6(ATP7A): c.2981C>T (p.Thr994Ile) | CCAAGCCTCTATCAYGAGTTCTGT | Distal spinal muscular atrophy, X-linked 3 |
| 201038679 | ATP7B | NM_000053.3(ATP7B): c.2975C>T (p.Pro992Leu) | CGTGRGCGTGGCCAGCCCCAGGG, CCGTGRGCGTGGCCAGCCCCAGG | Wilson disease |
| 28942076 | ATP7B | NM_000053.3(ATP7B): c.2827G>A (p.Gly943Ser) | GTAATCRGTTTTATCGATTTTGG | Wilson disease |
| 137853283 | ATP7B | NM_000053.3(ATP7B): c.2336G>A (p.Trp779Ter) | GGGCCGGTRGCTGGAACACTTGG | Wilson disease |
| 587783306 | ATP7B | NM_000053.3(ATP7B): c.2865+1G>A | TCCTRTAAGTTGAATGCCTTGGG, TTCCTRTAAGTTGAATGCCTTGG | Wilson disease |
| 72552255 | ATP7B | NM_000053.3(ATP7B): c.2930C>T (p.Thr977Met) | CCGGAACCCAAGTTCRTCACGTT | Wilson disease, not provided |
| 121907994 | ATP7B | NM_000053.3(ATP7B): c.2621C>T (p.Ala874Val) | CCCGGAAGCACTGTAATTGYGGG, CCGGAAGCACTGTAATTGYGGGG | Wilson disease |
| 121909101 | ATP8B1 | NM_005603.4(ATP8B1): c.1660G>A (p.Asp554Asn) | CTCTCCCRATGAAGGTGCCCTGG | Progressive intrahepatic cholestasis |
| 122445104 | ATRX | NM_000489.4(ATRX): c.5225G>A (p.Arg1742Lys) | AGGARGAGGATTATTTTAACAGG | ATR-X syndrome |
| 122445099 | ATRX | NM_000489.4(ATRX): c.7156C>T (p.Arg2386Ter) | CCAGGAGCTTGATGTTAAAYGAA | ATR-X syndrome |
| 730880309 | AUH | NM_001698.2(AUH): c.895-1G>A | CTCARGTCGATTTAGTAACAGGG, TCTCARGTCGATTTAGTAACAGG | 3-Methylglutaconic aciduria |
| 121908654 | AURKC | NM_001015879.1(AURKC): c.629G>A (p.Cys210Tyr) | GCTCTRCTATGAGCTGCTGGTGG, AGTGCTCTRCTATGAGCTGCTGG | Infertility associated with multi-tailed spermatozoa and excessive DNA |
| 121964882 | AVP | NM_000490.4(AVP): c.262G>A (p.Gly88Ser) | AGTCCRGCCAGAAGGCGTGCGGG, CAGTCCRGCCAGAAGGCGTGCGG | Neurohypophyseal diabetes insipidus |
| 121964890 | AVP | NM_000490.4(AVP): c.260C>T (p.Ser87Phe) | CCGTCGCCCTGCCAGTYCGGCCA | Neurohypophyseal diabetes insipidus |
| 121964892 | AVP | NM_000490.4(AVP): c.20C>T (p.Pro7Leu) | CCTGACACCATGCTGCYCGCCTG | |
| 28935496 | AVPR2 | NM_000054.4(AVPR2): c.337C>T (p.Arg113Trp) | CCAGATGCCCTGTGTYGGGCCGT | Nephrogenic diabetes insipidus, X-linked |
| 104894760 | AVPR2 | NM_000054.4(AVPR2): c.310C>T (p.Arg104Cys) | CCTGGAAGGCCACCGACYGCTTC | Nephrogenic diabetes insipidus, Nephrogenic diabetes insipidus, X-linked |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 730882193 | AXIN2 | NM_004655.3(AXIN2): c.1989G>A (p.Trp663Ter) | ATCTGTGRGGGGCAACAGCGGG, CATCTGTGRGGGGGCAACAGCGG | Oligodontia-colorectal cancer syndrome |
| 121908568 | AXIN2 | NM_004655.3(AXIN2): c.1966C>T (p.Arg656Ter) | CCGCTCGTCTCCAGGCGAAYGAG | Oligodontia-colorectal cancer syndrome |
| 367543074 | B3GALNT2 | NM_152490.4(B3GALNT2): c.802G>A (p.Val268Met) | GGTRTGGAGGGAGTTGCAGGTGG, GAAGGTRTGGAGGGAGTTGCAGG | Congenital muscular dystrophy-dystroglycanopathy with brain and eye anomalies, type AII, not provided |
| 397514722 | B3GALT6 | NM_080605.3(B3GALT6): c.16C>T (p.Arg6Trp) | CGCCCRCCGCAGCAGCTTCATGG | Ehlers-Danlos syndrome, progeroid type, 2 |
| 397514724 | B3GALT6 | NM_080605.3(B3GALT6): c.649G>A (p.Gly217Ser) | CCGAGAGCACGTAGCYGCCGCCC | |
| 387906876 | BAG3 | NM_004281.3(BAG3): c.1430G>A (p.Arg477His) | GTGCRTCAGGCCAGGAGAGACGG | Dilated cardiomyopathy 1HH |
| 387906874 | BAG3 | NM_004281.3(BAG3): c.211C>T (p.Arg71Trp) | CCAATGGCCCTTCCYGGGAGGGC | Dilated cardiomyopathy 1HH, not provided |
| 387906871 | BANF1 | NM_003860.3(BANF1): c.34G>A (p.Ala12Thr) | CTTCGTGRCAGAGCCCATGGGGG, ACTTCGTGRCAGAGCCCATGGGG | Nestor-Guillermo progeria syndrome |
| 786202118 | BARD1 | NM_000465.3(BARD1): c.2268G>A (p.Trp756Ter) | TCTGRAGGCTCCTTCGAGCTGG | Hereditary cancer-predisposing syndrome |
| 587777829 | BBS1 | NM_024649.4(BBS1): c.432+1G>A | AAGAGRTAAATAAATAACATGGG, AAAGAGRTAAATAAATAACATGG | Bardet-Biedl syndrome, Bardet-Biedl syndrome 1 |
| 121908178 | BBS2 | NM_031885.3(BBS2): c.943C>T (p.Arg315Trp) | CCTTCTGTTCAGTCYGGGGCTAC | |
| 121908180 | BBS2 | NM_031885.3(BBS2): c.646C>T (p.Arg216Ter) | CCCATGTATGGCAGTYGATTTGG, CCATGTATGGCAGTYGATTTGGT | |
| 119466002 | BBS7 | NM_176824.2(BBS7): c.632C>T (p.Thr211Ile) | CCTTTTGTTTGGGAYATCAGACG | Bardet-Biedl syndrome |
| 121918133 | BCAM | NM_005581.4(BCAM): c.361C>T (p.Arg121Ter) | CCCAGGTGGGCGACGAGYGAGAC, CCAGGTGGGCGACGAGYGAGACT | |
| 375785084 | BCKDHA | NM_000709.3(BCKDHA): c.659C>T (p.Ala220Val) | CCTGCAGCGGTGGGGGCGGYGTA | Maple syrup urine disease, not provided |
| 398123497 | BCKDHA | NM_000709.3(BCKDHA): c.288+9C>T | CCCCCACGTGAGAGGYGGCCTCC, CCCCACGTGAGAGGYGGCCTCCC | Maple syrup urine disease, not provided |
| 398123503 | BCKDHA | NM_000709.3(BCKDHA): c.632C>T (p.Thr211Met) | CCTCTCCACTGGCCAYGCAGATC | Maple syrup urine disease, not provided |
| 137852873 | BCKDHA | NM_000709.3(BCKDHA): c.793C>T (p.Arg265Trp) | CCCCATCATCTTCTTCTGCYGGA, CCCATCATCTTCTTCTGCYGGAA, CCATCATCTTCTTCTGCYGGAAC | Maple syrup urine disease type 1A |
| 398124602 | BCKDHB | NM_000056.3(BCKDHB): c.952-1G>A | TTCARTCTGTGATCAAAACAGGG, TTTCARTCTGTGATCAAAACAGG | Maple syrup urine disease, not provided |
| 121965004 | BCKDHB | NM_000056.3(BCKDHB): c.616C>T (p.His206Tyr) | CCTGAAGCATTTTTTGCCYATTG | |
| 397514573 | BCKDK | NM_005881.3(BCKDK): c.466C>T (p.Arg156Ter) | CCAGTACTGCCAGCTGGTGYGAC | Branched-chain ketoacid dehydrogenase kinase deficiency |
| 121908571 | BCS1L | NM_004328.4(BCS1L): c.830G>A (p.Ser277Asn) | GCAGARCCTGGTACTCCTGGAGG, GCAGCAGARCCTGGTACTCCTGG | Mitochondrial complex III deficiency |
| 121908578 | BCS1L | NM_004328.4(BCS1L): c.550C>T (p.Arg184Cys) | CCCTTTGGCTATCCACGCYGCCG, CCTTTGGCTATCCACGCYGCCGG | Mitochondrial complex III deficiency |
| 28940276 | BEST1 | NM_004183.3(BEST1): c.25G>A (p.Val9Met) | CAARTGGCTAATGCCCGCTTAGG | Vitelliform dystrophy, not provided |
| 121918287 | BEST1 | NM_004183.3(BEST1): c.949G>A (p.Val317Met) | CCAGRTGTCCCTGTTGGCTGTGG | Bestrophinopathy, autosomal recessive |
| 28940570 | BEST1 | NM_004183.3(BEST1): c.728C>T (p.Ala243Val) | CCCAGGTGGTGACTGTGGYGGTG, CCAGGTGGTGACTGTGGYGGTGT | Vitelliform dystrophy, not provided |
| 372989281 | BEST1 | NM_004183.3(BEST1): c.763C>T (p.Arg255Trp) | CCTGACTTGTCTAGTTGGGYGGC | Retinitis pigmentosa |
| 398123028 | BICD2 | NM_015250.3(BICD2): c.320C>T (p.Ser107Leu) | CCTGATCCAGGAGTYGGCCTCCA | Spinal muscular atrophy, lower extremity predominant 2, autosomal dominant |
| 587783343 | BIN1 | NM_139343.2(BIN1): c.1713G>A (p.Trp571Ter) | CTGRAACCAGCACAAGGAGCTGG | Autosomal recessive centronuclear myopathy |
| 55758736 | BLK | NM_001715.2(BLK): c.211G>A (p.Ala71Thr) | CTACACCRCTATGAATGATCGGG, ACTACACCRCTATGAATGATCGG | Maturity-onset diabetes of the young, type 11, not specified |
| 367543025 | BLM | NM_000057.3(BLM): c.3197G>A (p.Cys1066Tyr) | TGATAATTRCTGTAAAACAAAGG | Bloom syndrome |
| 104894763 | BMP15 | NM_005448.2(BMP15): c.202C>T (p.Arg68Trp) | CCTAGGGCATTCACTGYGGTACA | Premature ovarian failure 4 |
| 137853320 | BMP15 | NM_005448.2(BMP15): c.631C>T (p.Gln211Ter) | CCGTTTTATGTGTCAGYAGCAAA | Premature ovarian failure 4 |
| 121912766 | BMP4 | NM_001202.3(BMP4): c.1037C>T (p.Ala346Val) | CCCCTTTCCACTGGYTGACCACC | Orofacial cleft 11 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199476088 | BMPR1A | NM_004329.2(BMPR1A): c.1127G>A (p.Cys376Tyr) | AGTTRCTGCATTGCTGACCTGGG, GAGTTRCTGCATTGCTGACCTGG | Juvenile polyposis syndrome |
| 764466442 | BMPR1A | NM_004329.2(BMPR1A): c.1081C>T (p.Arg361Ter) | CCCGCAATTGCTCATYGAGACCT, CCGCAATTGCTCATYGAGACCTA | Hereditary cancer-predisposing syndrome |
| 137852744 | BMPR2 | NM_001204.6(BMPR2): c.1040G>A (p.Cys347Tyr) | ACCTRTGTTATTAGTGACTTTGG | Primary pulmonary hypertension |
| 137852746 | BMPR2 | NM_001204.6(BMPR2): c.1471C>T (p.Arg491Trp) | CCAGGATGCAGAGGCTYGGCTTA | Primary pulmonary hypertension |
| 137852751 | BMPR2 | NM_001204.6(BMPR2): c.994C>T (p.Arg332Ter) | CCTGCAATTTCCCATYGAGATTT | Primary pulmonary hypertension |
| 137852756 | BMPR2 | NM_001204.6(BMPR2): c.1297C>T (p.Gln433Ter) | CCGTACCAGAGTACYAGATGGCT | Pulmonary hypertension, primary, 1, with hereditary hemorrhagic telangiectasia |
| 121964925 | BPGM | NM_199186.2(BPGM): c.268C>T (p.Arg90Cys) | CCTGGCGTCTAAATGAGYGTCAC | Deficiency of bisphosphoglycerate mutase |
| 397516894 | BRAF | NM_004333.4(BRAF): c.1720C>T (p.His574Tyr) | CCAAGTCAATCATCYACAGAGAC | Cardiofaciocutaneous syndrome |
| 397509284 | BRCA1 | NM_007294.3(BRCA1): c.5445G>A (p.Trp1815Ter) | GATGCCTGRACAGAGGACAATGG | Familial cancer of breast, Breast-ovarian cancer, familial 1, Hereditary cancer-predisposing syndrome |
| 80356937 | BRCA1 | NM_007294.3(BRCA1): c.5212G>A (p.Gly1738Arg) | GTCAGARGAGATGTGGTCAATGG | Familial cancer of breast, Breast-ovarian cancer, familial 1 |
| 80356962 | BRCA1 | NM_007294.3(BRCA1): c.5444G>A (p.Trp1815Ter) | GATGCCTRGACAGAGGACAATGG | Familial cancer of breast, Hereditary breast and ovarian cancer syndrome, Breast-ovarian cancer, familial 1, Hereditary cancer-predisposing syndrome |
| 80357219 | BRCA1 | NM_007294.3(BRCA1): c.5345G>A (p.Trp1782Ter) | GAATRGATGGTACAGCTGTGTGG | Familial cancer of breast, Breast-ovarian cancer, familial 1 |
| 80357284 | BRCA1 | NM_007294.3(BRCA1): c.5346G>A (p.Trp1782Ter) | GAATGRATGGTACAGCTGTGTGG | Familial cancer of breast, Breast-ovarian cancer, familial 1, Hereditary cancer-predisposing syndrome |
| 80357292 | BRCA1 | NM_007294.3(BRCA1): c.962G>A (p.Trp321Ter) | TAACAGATRGGCTGGAAGTAAGG | Familial cancer of breast, Hereditary breast and ovarian cancer syndrome, Breast-ovarian cancer, familial 1, Hereditary cancer-predisposing syndrome |
| 80358008 | BRCA1 | NM_007294.3(BRCA1): c.4676-1G>A | TTCARAGGGAACCCCTTACCTGG | Breast-ovarian cancer, familial 1 |
| 80358070 | BRCA1 | NM_007294.3(BRCA1): c.4097-1G>A | TTTAARGTGAAGCAGCATCTGGG, ATTTAARGTGAAGCAGCATCTGG | Familial cancer of breast, Breast-ovarian cancer, familial 1 |
| 62625307 | BRCA1 | NM_007294.3(BRCA1): c.3598C>T (p.Gln1200Ter) | CCCATACACATTTGGCTYAGGGT, CCATACACATTTGGCTYAGGGTT | Familial cancer of breast, Hereditary breast and ovarian cancer syndrome, Breast-ovarian cancer, familial 1, Hereditary cancer-predisposing syndrome |
| 80356952 | BRCA1 | NM_007294.3(BRCA1): c.1630C>T (p.Gln544Ter) | CCAAACGGAGCAGAATGGTYAAG | Familial cancer of breast, Breast-ovarian cancer, familial 1 |
| 80357089 | BRCA1 | NM_007294.3(BRCA1): c.3331C>T (p.Gln1111Ter) | CCTGAAATAAAAAAGYAAGAATA | Familial cancer of breast, Breast-ovarian cancer, familial 1 |
| 80357123 | BRCA1 | NM_007294.3(BRCA1): c.5251C>T (p.Arg1751Ter) | CCACCAAGGTCCAAAGYGAGCA | Familial cancer of breast, Hereditary breast and ovarian cancer syndrome, Breast-ovarian cancer, familial 1, Hereditary cancer-predisposing syndrome |
| 80357211 | BRCA1 | NM_007294.3(BRCA1): c.949C>T (p.Gln317Ter) | CCTGGCTTAGCAAGGAGCYAACA | Familial cancer of breast, Breast-ovarian cancer, familial 1 |
| 80357372 | BRCA1 | NM_007294.3(BRCA1): c.415C>T (p.Gln139Ter) | CCGTGCCAAAAGACTTCTAYAGA, CCAAAAGACTTCTAYAGAGTGAA | Familial cancer of breast, Breast-ovarian cancer, familial 1 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80357471 | BRCA1 | NM_007294.3(BRCA1): c.178C>T (p.Gln60Ter) | CCAGAAGAAAGGGCCTTCAYAGT | Familial cancer of breast, Breast-ovarian cancer, familial 1 |
| 587781506 | BRCA2 | NM_000059.3(BRCA2): c.7877G>A (p.Trp2626Ter) | TAGATRGATCATATGGAAACTGG | Hereditary breast and ovarian cancer syndrome, Hereditary cancer-predisposing syndrome |
| 80358543 | BRCA2 | NM_000059.3(BRCA2): c.2978G>A (p.Trp993Ter) | AACAAATRGGCAGGACTCTTAGG | Breast-ovarian cancer, familial 2 |
| 80358544 | BRCA2 | NM_000059.3(BRCA2): c.2979G>A (p.Trp993Ter) | AACAAATGRGCAGGACTCTTAGG | Familial cancer of breast, Breast-ovarian cancer, familial 2, Hereditary cancer-predisposing syndrome |
| 80359015 | BRCA2 | NM_000059.3(BRCA2): c.7886G>A (p.Trp2629Ter) | CATATRGAAACTGGCAGCTATGG | Familial cancer of breast, Breast-ovarian cancer, familial 2 |
| 80359205 | BRCA2 | NM_000059.3(BRCA2): c.99317G>A (p.Trp3106Ter) | GTTTTRGATAGACCTTAATGAGG | Familial cancer of breast, Breast-ovarian cancer, familial 2 |
| 80359803 | BRCA2 | NM_000059.3(BRCA2): c.8754G>A (p.Glu2918=) | CCTTGARGTGAGAGAGTAAGAGG | Familial cancer of breast, Breast-ovarian cancer, familial 2, Hereditary cancer-predisposing syndrome |
| 730881581 | BRCA2 | NM_000059.3(BRCA2): c.8174G>A (p.Trp2725Ter) | AGATGGGTRGTATGCTGTTAAGG | Familial cancer of breast |
| 276174913 | BRCA2 | NM_000059.3(BRCA2): c.8869C>T (p.Gln2957Ter) | CCATGGAATCTGCTGAAYAAAAG | Familial cancer of breast, Breast-ovarian cancer, familial 2 |
| 80358515 | BRCA2 | NM_000059.3(BRCA2): c.250C>T (p.Gln84Ter) | CCAATAATATTCAAAGAGYAAGG | Familial cancer of breast, Hereditary breast and ovarian cancer syndrome, Breast-ovarian cancer, familial 2 |
| 80358578 | BRCA2 | NM_000059.3(BRCA2): c.3319C>T (p.Gln1107Ter) | CCATAATTTAACACCTAGCYAAA | Familial cancer of breast, Breast-ovarian cancer, familial 2, Hereditary cancer-predisposing syndrome |
| 80358851 | BRCA2 | NM_000059.3(BRCA2): c.6124C>T (p.Gln2042Ter) | CCAGAACATTTAATATCCYAAAA | Hereditary breast and ovarian cancer syndrome, Breast-ovarian cancer, familial 2 |
| 80358920 | BRCA2 | NM_000059.3(BRCA2): c.6952C>T (p.Arg2318Ter) | CCTAGGCACAATAAAAGATYGAA | Familial cancer of breast, Breast-ovarian cancer, familial 2 |
| 587782010 | BRCA2 | NM_000059.3(BRCA2): c.8608C>T (p.Gln2870Ter) | CCTTATTCACTAAAATTYAGGAG | Hereditary cancer-predisposing syndrome |
| 587782613 | BRCA2 | NM_000059.3(BRCA2): c.3412C>T (p.Gln1138Ter) | CCAAGCTACATATTGYAGAAGAG | Hereditary cancer-predisposing syndrome |
| 397507395 | BRCA2 | NM_000059.3(BRCA2): c.7963C>T (p.Gln2655Ter) | CCCAGAAAGGGTGCTTCTTYAAC, CCAGAAAGGGTGCTTCTTYAACT | Familial cancer of breast, Breast-ovarian cancer, familial 2 |
| 397507617 | BRCA2 | NM_000059.3(BRCA2): c.196C>T (p.Gln66Ter) | CCTATTTAAAACTCCAYAAAGGA | Familial cancer of breast, Breast-ovarian cancer, familial 2, Hereditary cancer-predisposing syndrome |
| 587782539 | BRIP1 | NM_032043.2(BRIP1): c.2576-1G>A | TTCTTTARGACTTTCTAAATGGG, TTTCTTTARGACTTTCTAAATGG | Hereditary cancer-predisposing syndrome |
| 137852985 | BRIP1 | NM_032043.2(BRIP1): c.897G>A (p.Met299Ile) | AGTGCATRGAATTGCTAGATGGG, AAGTGCATRGAATTGCTAGATGG | Breast cancer, early-onset |
| 587782574 | BRIP1 | NM_032043.2(BRIP1): c.2377C>T (p.Gln793Ter) | CCAAATGTGAAAGATCTAYAGGT | Hereditary cancer-predisposing syndrome |
| 730881633 | BRIP1 | NM_032043.2(BRIP1): c.1066C>T (p.Arg356Ter) | CCATATTCACAGCCYGAGAACT | Hereditary cancer-predisposing syndrome |
| 74315287 | BSND | NM_057176.2(BSND): c.28G>A (p.Gly10Ser) | GGATCRGCTTCATTGTGCTGGGG, CGGATCRGCTTCATTGTGCTGGG, CCGGATCRGCTTCATTGTGCTGG | Bartter syndrome type 4 |
| 74315289 | BSND | NM_057176.2(BSND): c.139G>A (p.Gly47Arg) | TGGTGATCRGGGGCATCATCTGG | Bartter syndrome type 4 |
| 146015592 | BTD | NM_000060.3(BTD): c.470G>A (p.Arg157His) | GCTCCAGCRCCTGAGTTGTATGG | Biotinidase deficiency, not provided |
| 397514396 | BTD | NM_000060.3(BTD): c.934G>A (p.Gly312Ser) | AAGTRGCATACACACCCCTCTGG | Biotinidase deficiency |
| 397514343 | BTD | NM_000060.3(BTD): c.236G>A (p.Arg79His) | CATCAGCCRCCAAGAGGCCTTGG | Biotinidase deficiency |
| 397514375 | BTD | NM_000060.3(BTD): c.595G>A (p.Val199Met) | AATGTCRTGTTCAGCAATAATGG | Biotinidase deficiency |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397514417 | BTD | NM_000060.3(BTD): c.1333G>A (p.Gly445Arg) | GATRGGCTTCACACAGTACATGG | Biotinidase deficiency |
| 397514428 | BTD | NM_000060.3(BTD): c.1610G>A (p.Gly537Glu) | CTATGRGCGCTTGTATGAGAGGG, TCTATGRGCGCTTGTATGAGAGG | Biotinidase deficiency |
| 397514429 | BTD | NM_000060.3(BTD): c.1613G>A (p.Arg538His) | CTATGGGCRCTTGTATGAGAGGG | Biotinidase deficiency |
| 367902696 | BTD | NM_000060.3(BTD): c.443G>A (p.Arg148His) | TCACCRCTTCAATGACACAGAGG | Biotinidase deficiency |
| 34885143 | BTD | NM_000060.3(BTD): c.133G>A (p.Gly45Arg) | CCACACCRGGGAGGAGAGCGTGG | Biotinidase deficiency, not specified, not provided |
| 146600671 | BTD | NM_000060.3(BTD): c.1369G>A (p.Val457Met) | TCCAARTGTGTGCCCTGGTCAGG | Biotinidase deficiency |
| 377651057 | BTD | NM_000060.3(BTD): c.935G>A (p.Gly312Asp) | AAGTGRCATACACACCCCTCTGG | Biotinidase deficiency |
| 104893687 | BTD | NM_000060.3(BTD): c.235C>T (p.Arg79Cys) | CCCTCTGGCTCTCATCAGCYGCC, CCTCTGGCTCTCATCAGCYGCCA | Biotinidase deficiency, not provided |
| 104893688 | BTD | NM_000060.3(BTD): c.1595C>T (p.Thr532Met) | CCTCTGGGCTGGTGAYGGCGGCT | Biotinidase deficiency, not provided |
| 397514349 | BTD | NM_000060.3(BTD): c.283C>T (p.Gln95Ter) | CCTTGACATCTATGAAYAGCAAG | Biotinidase deficiency |
| 397514363 | BTD | NM_000060.3(BTD): c.469C>T (p.Arg157Cys) | CCTCTAGGTGCTCCAGYGCCTGA | Biotinidase deficiency |
| 397514364 | BTD | NM_000060.3(BTD): c.485C>T (p.Ala162Val) | CCTGAGTTGTATGGYCATCAGGG | Biotinidase deficiency |
| 372844636 | BTD | NM_000060.3(BTD): c.631C>T (p.Arg211Cys) | CCCTTGTTGACCGCTACYGTAAA, CCTTGTTGACCGCTACYGTAAAC | Biotinidase deficiency |
| 128621209 | BTK | NM_000061.2(BTK): c.1838G>A (p.Gly613Asp) | CCCAAGRCCTACGTCTCTACAGG | X-linked agammaglobulinemia |
| 128621194 | BTK | NM_000061.2(BTK): c.862C>T (p.Arg288Trp) | CCAAACACATGACTYGGAGTCAG | X-linked agammaglobulinemia |
| 128621204 | BTK | NM_000061.2(BTK): c.1684C>T (p.Arg562Trp) | CCAAATTTCCAGTCYGGTGGTCC | X-linked agammaglobulinemia |
| 128621193 | BTK | NM_000061.2(BTK): c.763C>T (p.Arg255Ter) | CCATGGTGGAGAGCAYGAGATAA | X-linked agammaglobulinemia |
| 137852956 | C10orf2 | NM_021830.4(C10orf2): c.908G>A (p.Arg303Gln) | GGCRGATTGTATTCTGGTTGGGG, CGGCRGATTGTATTCTGGTTGGG, CCGGCRGATTGTATTCTGGTTGG | Autosomal dominant progressive external ophthalmoplegia with mitochondrial DNA deletions 3 |
| 80356544 | C10orf2 | NM_021830.4(C10orf2): c.1370C>T (p.Thr457Ile) | CCCGGGTCATGCTGAYACAGTTT, CCGGGTCATGCTGAYACAGTTTG | Mitochondrial DNA-depletion syndrome 3, hepatocerebral, Mitochondrial DNA depletion syndrome 7 (hepatocerebral type) |
| 587777698 | C12orf57 | NM_138425.3(C12orf57): c.184C>T (p.Gln62Ter) | CCCGTGGCCACGCAGATCYAGCA, CCGTGGCCACGCAGATCYAGCAG | Temtamy syndrome |
| 397514539 | C12orf65 | NM_152269.4(C12orf65): c.394C>T (p.Arg132Ter) | CCTGTTCACAAAGAAAAAYGAGA | Spastic paraplegia 55, autosomal recessive |
| 397514477 | C19orf12 | NM_001031726.3 (C19orf12):c.32C>T (p.Thr11Met) | CCCTCGAAGGCCCGCCAYGATGA, CCTCGAAGGCCCGCCAYGATGAC | Neurodegeneration with brain iron accumulation 4 |
| 587777653 | C2CD3 | NM_001286577.1(C2CD3): c.184C>T (p.Arg62Ter) | ACTCRGACAAGTACACAAGTGGG, CACTCRGACAAGTACACAAGTGG | Joubert syndrome, Orofaciodigital syndrome xiv |
| 121909587 | C5 | NM_001735.2(C5) c.55C>T(p.Gln19Ter) | CCTGGGGAAAACCTGGGGAYAGG | Leiner disease |
| 139675596 | C5orf42 | NM_023073.3(C5orf42): c.7477C>T (p.Arg2493Ter) | TCTGGTCRAAAAGTCACATTTGG | Joubert syndrome 17 |
| 121434552 | CA4 | NM_000717.3(CA4): c.206G>A (p.Arg69His) | CTGGGACRCTTCTTCTTCTCTGG | Retinitis pigmentosa 17 |
| 104894559 | CA4 | NM_000717.3(CA4): c.40C>T (p.Arg14Trp) | CCTGGCCCTCTCCGCGGCYGGC, CCCTCTCCGCGGCYGGCCATCG | Retinitis pigmentosa 17 |
| 147623570 | CA5A | NM_001739.1(CA5A): c.555G>A (p.Lys185=) | CCCGAGCAAGTGATTACYTTTAA, CCGAGCAAGTGATTACYTTTAAA | Carbonic anhydrase VA deficiency, hyperammonemia due to |
| 121908215 | CACNA1A | NM_001127221.1(CACNA1A): c.877G>A (p.Gly293Arg) | ACTGGGAARGGCCCAACAACGGG | Spinocerebellar ataxia 6, Episodic ataxia type 2 |
| 121908216 | CACNA1A | NM_001127221.1(CACNA1A): c.4982G>A (p.Arg1661His) | TCCRCCTCTTCCGAGCTGCCCGG | Episodic ataxia type 2 |
| 121908236 | CACNA1A | NM_001127221.1(CACNA1A): c.860G>A (p.Cys287Tyr) | AATRTCAGCCCTACTGGGAAGGG, AAATRTCAGCCCTACTGGGAAGG, GACCAAATRTCAGCCCTACTGGG | Episodic ataxia type 2 |
| 121908212 | CACNA1A | NM_001127221.1(CACNA1A): c.1997C>T (p.Thr666Met) | CCCCTTTCAGATCCTGAYGGGCG, CCCTTTCAGATCCTGAYGGGCGA, CCTTTCAGATCCTGAYGGGCGAA | Familial hemiplegic migraine type 1 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909323 | CACNA1A | NM_001127221.1(CACNA1A): c.3832C>T (p.Arg1278Ter) | CCCTTACAGGTGCTGYGATACTT, CCTTACAGGTGCTGYGATACTTT | Episodic ataxia type 2 |
| 121909324 | CACNA1A | NM_001127221.1(CACNA1A): c.4636C>T (p.Arg1546Ter) | CCAAGCCGCTGACCYGACACATG | Episodic ataxia type 2 |
| 587776693 | CACNA1A | NM_001127221.1(CACNA1A): c.3992+1G>A | CCCTTGCGAGGAGACTTAYGTGA, CCTTGCGAGGAGACTTAYGTGAA | Episodic ataxia type 2 |
| 80315385 | CACNA1C | NM_000719.6(CACNA1C): c.1204G>A (p.Gly402Ser) | TGGTTCTCRGTGTGCTTAGCGGG | Timothy syndrome, Congenital long QT syndrome |
| 79891110 | CACNA1C | NM_000719.6(CACNA1C): c.1216G>A (p.Gly406Arg) | TTAGCRGGTAAGCAGGACCAAGG | Timothy syndrome, Long QT syndrome, Congenital long QT syndrome, not provided |
| 587782933 | CACNA1C | NM_001167623.1(CACNA1C): c.1204G>A (p.Gly402Ser) | TGGTTCTCRGTGTGTTGAGCGGG | Paroxysmal familial ventricular fibrillation, not provided |
| 122456133 | CACNA1F | NM_005183.3(CACNA1F): c.1106G>A (p.Gly369Asp) | TTGRCGTCCTGAGTGGGTGAGGG, CTTGRCGTCCTGAGTGGGTGAGG | Congenital stationary night blindness, type 2A |
| 122456135 | CACNA1F | NM_005183.3(CACNA1F): c.2683C>T (p.Arg895Ter) | CCGCTGAGGACCCCATCYGAGCC | Congenital stationary night blindness, type 2A |
| 80338777 | CACNA1S | NM_000069.2(CACNA1S): c.1583G>A (p.Arg528His) | TCCRCTGCATCCGCCTCCTGAGG | Hypokalemic periodic paralysis 1 |
| 587777742 | CACNB2 | NM_201590.2(CACNB2): c.32C>T (p.Thr11Ile) | CCTTATAGCTCCTCAAAYTAAAT | Brugada syndrome 4 |
| 121917812 | CACNB2 | NM_201590.2(CACNB2): c.1442C>T (p.Ser481Leu) | CCGCTCTTCCTCCTYAGCCCCAC | Brugada syndrome 4 |
| 267606699 | CANT1 | NM_001159772.1(CANT1): c.899G>A (p.Arg300His) | CCTGCCGCRCCGCGCCAGCCAGG | Desbuquois syndrome |
| 587776951 | CANT1 | NM_001159772.1(CANT1): c.-286+1G>A | CCGCGGGCGCAGTCACTCAYCCG | Desbuquois syndrome |
| 377546036 | CANT1 | NM_001159772.1(CANT1): c.676G>A (p.Val226Met) | CCTTGCCCAGGCCGCCCAYGTAC | Desbuquois syndrome |
| 141656719 | CAPN3 | NM_000070.2(CAPN3): c.1468C>T (p.Arg490Trp) | CCTGATGCAGAAGAACCGGYGGA | Limb-girdle muscular dystrophy, type 2A, not provided |
| 121434546 | CAPN3 | NM_000070.2(CAPN3): c.257C>T (p.Ser86Phe) | CCCACCGGATGAGACCYTYCTCT, CCACCGGATGAGACCYTYCTCTT | Limb-girdle muscular dystrophy, type 2A |
| 587777763 | CARD14 | NM_024110.4(CARD14): c.349+5G>A | GGTGARAGCTCCGACTTTGACGG | Psoriasis susceptibility 2 |
| 398122362 | CARD9 | NM_052813.4(CARD9): c.214G>A (p.Gly72Ser) | GACCRGCCACAAGGGCTACGTGG | Candidiasis, familial, 2 |
| 557671802 | CARS2 | NM_024537.3(CARS2): c.752C>T (p.Pro251Leu) | CCCRGCCTCCCGGGTCCCCAGGG, GCCCRGCCTCCCGGGTCCCCAGG | Alpers encephalopathy |
| 794727270 | CASK | NM_003688.3(CASK): c.79C>T (p.Arg27Ter) | CCCTTCAGTGTTGTAYGACGATG, CCTTCAGTGTTGTAYGACGATGT | FG syndrome 4, Mental retardation and microcephaly with pontine and cerebellar hypoplasia |
| 587783361 | CASK | NM_003688.3(CASK): c.2074C>T (p.Gln692Ter) | CCATGGAGAAGACCAAAYAGGAG | Mental retardation and microcephaly with pontine and cerebellar hypoplasia |
| 587783364 | CASK | NM_003688.3(CASK): c.2470C>T (p.Gln824Ter) | CCGGAAGATCCACGAGYAGGGGC | Mental retardation and microcephaly with pontine and cerebellar hypoplasia |
| 587783371 | CASK | NM_003688.3(CASK): c.880C>T (p.Gln294Ter) | CCAGAAACAGTAGAGYAGCTGAG | Mental retardation and microcephaly with pontine and cerebellar hypoplasia |
| 28936699 | CASP10 | NM_032977.3(CASP10): c.1241C>T (p.Ala414Val) | CCTTCCGTATCCATCGAAGYAGA, CCGTATCCATCGAAGYAGATGCT | Malignant lymphoma, non-Hodgkin |
| 104893700 | CASR | NM_000388.3(CASR): c.2009G>A (p.Gly670Glu) | TCATCGRGGAGCCCCAGGACTGG | Hyperparathyroidism, neonatal severe |
| 104893712 | CASR | NM_000388.3(CASR): c.1810G>A (p.Glu604Lys) | GATCRAGTTTCTGTCGTGGACGG, AGGAGATCRAGTTTCTGTCGTGG | Hypocalcemia, autosomal dominant 1 |
| 104893719 | CASR | NM_000388.3(CASR): c.1657G>A (p.Gly553Arg) | CAGGAAARGGATCATTGAGGGGG, CCAGGAAARGGATCATTGAGGGG | Hypocalciuric hypercalcemia, familial, type 1 |
| 121909264 | CASR | NM_000388.3(CASR): c.428G>A (p.Gly143Glu) | GTGGTGGRAGCAACTGGCTCAGG | Hypocalciuric hypercalcemia, familial, type 1 |
| 121909266 | CASR | NM_000388.3(CASR): c.196C>T (p.Arg66Cys) | CCAGGTATAATTTCYGTGGGTTT | Hypocalciuric hypercalcemia, familial, type 1 |
| 267606708 | CBL | NM_005188.3(CBL): c.1259G>A (p.Arg420Gln) | TTCTGCCRATGTGAAATTAAAGG | Noonan syndrome-like disorder with or without juvenile myelomonocytic leukemia |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28934891 | CBS | NM_000071.2(CBS): c.1330G>A (p.Asp444Asn) | CTTCRACCAGGCGCCCGTGGTGG, GGGCTTCRACCAGGCGCCCGTGG | Homocystinuria due to CBS deficiency, Homocystinuria, pyridoxine-responsive, not provided |
| 121908255 | CBX2 | NM_005189.2(CBX2): c.293C>T (p.Pro98Leu) | CCTTTATCTTTCCAGGAACYCGA | 46,XY sex reversal, type 5 |
| 377177061 | CC2D2A | NM_001080522.2(CC2D2A): c.394C>T (p.Arg132Ter) | CCTCGGCCCAGACGCTTAYGAAG | Meckel-Gruber syndrome |
| 201133219 | CCDC114 | NM_144577.3(CCDC114): c.1391+5G>A | CCCTCCTGCCCTGCGCYTCACAG, CCTCCTGCCCTGCGCYTCACAGA | Ciliary dyskinesia, primary, 20 |
| 374909386 | CCDC40 | NM_017950.3(CCDC40): c.3354C>A (p.Tyr1118Ter) | CCGCGTGCGGGACGAGTAHCCCC | Ciliary dyskinesia, primary, 15 |
| 387907092 | CCDC40 | NM_017950.3(CCDC40): c.1951C>T (p.Gln651Ter) | CCACCAAATACTTCAACYAGCTC, CCAAATACTTCAACYAGCTCATC | Ciliary dyskinesia, primary, 15 |
| 587782989 | CCDC88C | NM_001080414.3(CCDC88C): c.1391G>A (p.Arg464His) | GTCCAGCCRCATCCTGAAGCTGG | Spinocerebellar ataxia 40 |
| 387907320 | CCDC88C | NM_001080414.3(CCDC88C): c.5058+1G>A | CCATRTGAGTGATCCGGACACGG | Hydrocephalus |
| 137852841 | CCM2 | NM_001029835.2(CCM2): c.382C>T (p.Gln128Ter) | CCGGGACACTTGACTYAGGAGCA | Cerebral cavernous malformations 2 |
| 587777929 | CCT7 | NM_001166284.1(CCT7): c.1313C>T (p.Ser438Leu) | CCATCAAGAACCCCCGCTYGACT | Myocardial infarction 1 |
| 74315290 | CD247 | NM_198053.2(CD247): c.208C>T (p.Gln70Ter) | CCAGCAGGGCCAGAACYAGCTCT | Immunodeficiency due to defect in cd3-zeta |
| 730880296 | CD3D | NM_000732.4(CD3D): c.274+5G>A | TACRTGCTTCCTGAACCCTTTGG | Immunodeficiency 19 |
| 193922136 | CD40LG | NM_000074.2(CD40LG): c.761C>T (p.Thr254Met) | CCATGGCACTGGCTTCAYGTCCT | Immunodeficiency with hyper IgM type 1 |
| 587776775 | CD81 | NM_004356.3(CD81): c.561+1G>A | CAAGRTGCGCGAGGCCGGTGGGG, TCAAGRTGCGCGAGGCCGGTGGG, TTCAAGRTGCGCGAGGCCGGTGG | |
| 121918660 | CD8A | NM_001768.6(CD8A): c.331G>A (p.Gly111Ser) | CGAGRGCTACTATTTCTGCTCGG | Cd8 deficiency, familial |
| 113313967 | CDAN1 | NM_138477.2(CDAN1): c.1860+5G>A | CCCTTGTTCTGTTTTYGGACCTG, CCTTGTTCTGTTTTYGGACCTGC | Congenital dyserythropoietic anemia, type I |
| 120074167 | CDAN1 | NM_138477.2(CDAN1): c.2015C>T (p.P672L) | CCCTCCCAGGTCCCTCYGGTCCT, CCTCCCAGGTCCCTCYGGTCCTG | Congenital dyserythropoietic anemia, type I |
| 80338696 | CDAN1 | NM_138477.2(CDAN1): c.2140C>T (p.Arg714Trp) | CCCTTGCTGGAATATTACYGGGA, CCTTGCTGGAATATTACYGGGAC | Congenital dyserythropoietic anemia, type I |
| 80338697 | CDAN1 | NM_138477.2(CDAN1): c.3124C>T (p.Arg1042Trp) | CCTTGGCCGTGGGGCCAYGGGAC | Congenital dyserythropoietic anemia, type I |
| 121434263 | CDC73 | NM_024529.4(CDC73): c.128G>A (p.Trp43Ter) | GTTTRGGGGTAAGTCCGGCATGG | Parathyroid carcinoma |
| 587776558 | CDC73 | NM_024529.4(CDC73): c.131+1G>A | GTTTGGGGRTAAGTCCGGCATGG | Hyperparathyroidism 1 |
| 587776559 | CDC73 | NM_024529.4(CDC73): c.238-1G>A | TTARACTGAAAATATTCCTGTGG | Hyperparathyroidism 2 |
| 786203576 | CDH1 | NM_004360.3(CDH1): c.60G>A (p.Trp20Ter) | CTCTTGRCTCTGCCAGGAGCCGG | Hereditary cancer-predisposing syndrome |
| 121964875 | CDH1 | NM_004360.3(CDH1): c.59G>A (p.Trp20Ter) | CTCTTRGCTCTGCCAGGAGCCGG | Hereditary diffuse gastric cancer |
| 121964877 | CDH1 | NM_004360.3(CDH1): c.1792C>T (p.Arg598Ter) | CCCCCATACCAGAACCTYGAACT, CCCCATACCAGAACCTYGAACTA, CCCATACCAGAACCTYGAACTAT, CCATACCAGAACCTYGAACTATA | Hereditary diffuse gastric cancer |
| 587782750 | CDH1 | NM_004360.3(CDH1): c.1921C>T (p.Gln641Ter) | CCAACTGGACCATTYAGTACAAC | Hereditary cancer-predisposing syndrome |
| 121434539 | CDH15 | NM_004933.2(CDH15): c.178C>T (p.Arg60Cys) | CCGAGAACCACAAGYGTCTCCCC | Mental retardation, autosomal dominant 3 |
| 397517353 | CDH23 | NM_022124.5(CDH23): c.7776G>A (p.Trp2592Ter) | CTGRGGCACCACCATGCTCCTGG | Usher syndrome, type 1D |
| 367928692 | CDH23 | NM_022124.5(CDH23): c.6050-9G>A | GCGGCACCRGGTGCCAGGTGTGG | Usher syndrome, type 1D |
| 727502931 | CDH23 | NM_022124.5(CDH23): c.7362+5G>A | GTGARCAGTGATGGAGGGCCTGG | Usher syndrome, type 1D |
| 121908354 | CDH23 | NM_022124.5(CDH23): c.719C>T (p.Pro240Leu) | CCCATCTTCATCAACCTGCYTTA, CCATCTTCATCAACCTGCYTTAC | Deafness, autosomal recessive 12 |
| 727503845 | CDK16 | NM_033018.3(CDK16): c.1258C>T (p.Arg420Ter) | CCTTTTGAGCCACGCACCCYGGT | not provided |
| 587783392 | CDK5RAP2 | NM_018249.5(CDK5RAP2): c.5227C>T (p.Gln1743Ter) | CCTGCTCAAACAGATCAGCYAGG | Primary autosomal recessive microcephaly 3 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587783086 | CDKL5 | NM_003159.2(CDKL5): c.577G>A (p.Asp193Asn) | TCCGTGRACATGTGGTCGGTGGG, GTCCGTGRACATGTGGTCGGTGG | not provided |
| 267608653 | CDKL5 | NM_003159.2(CDKL5): c.2152G>A (p.Val718Met) | TACAGARGTAAGCCCACCCCCGG | Early infantile epileptic encephalopathy 2, not provided |
| 122460158 | CDKL5 | NM_003159.2(CDKL5): c.2500C>T (p.Gln834Ter) | CCTTTCTTTCAGAGCYAGCCATT | Early infantile epileptic encephalopathy 2, Atypical Rett syndrome |
| 61749704 | CDKL5 | NM_003159.2(CDKL5): c.539C>T (p.Pro180Leu) | CCAGATGGTATCGGTCCCYAGAA | Early infantile epileptic encephalopathy 2 |
| 267606713 | CDKL5 | NM_003159.2(CDKL5): c.863C>T (p.Thr288Ile) | CCAGCTGACAGATACTTGAYAGA | Early infantile epileptic encephalopathy 2 |
| 587783089 | CDKL5 | NM_003159.2(CDKL5): c.700C>T (p.Gln234Ter) | CCACTTCCATCTGAGYAGATGAA | not provided |
| 587783158 | CDKL5 | NM_003159.2(CDKL5): c.2596C>T (p.Gln866Ter) | CCAGCCCTTAACAGCTCAAYAAA, CCCTTAACAGCTCAAYAAACCAA, CCTTAACAGCTCAAYAAACCAAA | Early infantile epileptic encephalopathy 2, not provided |
| 267608643 | CDKL5 | NM_003159.2(CDKL5): c.1648C>T (p.Arg550Ter) | CCCTTCTGGAAGAAATAACYGAA, CCTTCTGGAAGAAATAACYGAAA | Early infantile epileptic encephalopathy 2, Atypical Rett syndrome, not provided |
| 267608659 | CDKL5 | NM_003159.2(CDKL5): c.2413C>T (p.Gln805Ter) | CCCTGATCTTCTGACGTTGYAGA, CCTGATCTTCTGACGTTGYAGAA | Early infantile epileptic encephalopathy 2 |
| 267608663 | CDKL5 | NM_003159.2(CDKL5): c.2593C>T (p.Gln865Ter) | CCAGCCCTTAACAGCTYAACAAA | Early infantile epileptic encephalopathy 2 |
| 121917832 | CDKN1B | NM_004064.4(CDKN1B): c.227G>A (p.Trp76Ter) | GAGTRGCAAGAGGTGGAGAAGGG, CGAGTRGCAAGAGGTGGAGAAGG | Multiple endocrine neoplasia, type 4 |
| 387907225 | CDKN1C | NM_000076.2(CDKN1C): c.820G>A (p.Asp274Asn) | GATCTCCRGTGAGCCCCGCACGG | Intrauterine growth retardation, metaphyseal dysplasia, adrenal hypoplasia congenita, and genital anomalies |
| 387906918 | CDT1 | NM_030928.3(CDT1): c.196G>A (p.Ala66Thr) | CACCGRCCCGCAGGAGACTGCGG | Meier-Gorlin syndrome 4 |
| 145646425 | CEP164 | NM_014956.4(CEP164): c.1726C>T (p.Arg576Ter) | CCCCACCCATGGTAGGYGATCCA, CCCACCCATGGTAGGYGATCCAC, CCACCCATGGTAGGYGATCCACA | Nephronophthisis 15 |
| 387907310 | CEP164 | NM_014956.4(CEP164): c.277C>T (p.Arg93Trp) | CCATGTGACGAACACTATYGGAG | Nephronophthisis 15 |
| 387907311 | CEP164 | NM_014956.4(CEP164): c.1573C>T (p.Gln525Ter) | CCTGCAGCTGTCCCTCYAGAGGT | Nephronophthisis 15 |
| 371812716 | CEP41 | NM_018718.2(CEP41): c.1078C>T (p.Arg360Cys) | GGAGCRGGGGTTTGAGTGGCTGG | Joubert syndrome 9/15, digenic |
| 375801610 | CFAP53 | NM_145020.4(CFAP53): c.121C>T (p.Arg41Ter) | TGCGTCRGATTCTTTCTAGATGG | Heterotaxy, visceral, 6, autosomal |
| 398123065 | CFB | NM_001710.5(CFB): c.766C>T (p.Gln256Ter) | CCTGGCACCCAGGGGAAYAACAG | Complement factor B deficiency |
| 104893611 | CFC1 | NM_032545.3(CFC1): c.334C>T (p.Arg112Cys) | CCCGGCCCACTTCACCGGCYGCT, CCGGCCCACTTCACCGGCYGCTA, CCACTTCACCGGCYGCTACTGC | Heterotaxy, visceral, 2, autosomal |
| 121913053 | CFH | NM_000186.3(CFH): c.2876G>A (p.Cys959Tyr) | TACAAATRTTTTGAAGGTTTTGG | Factor H deficiency |
| 121964916 | CFI | NM_000204.3(CFI): c.728G>A (p.Gly243Asp) | TGTGATGRTATCAATGATTGTGG | Afibrinogenemia |
| 132630258 | CFP | NM_002621.2(CFP): c.481C>T (p.Arg161Ter) | CCCGGACCCGCAGGYGAGCCTGT | Properdin deficiency, X-linked |
| 672601317 | CFTR | NM_000492.3(CFTR): c.830G>A (p.Trp277Ter) | ATACTGCTRGGAAGAAGCAATGG | Cystic fibrosis |
| 121908753 | CFTR | NM_000492.3(CFTR): c.1055G>A (p.Arg352Gln) | GGTCACTCRGCAATTTCCCTGGG | Cystic fibrosis |
| 121909010 | CFTR | NM_000492.3(CFTR): c.3947G>A (p.Trp1316Ter) | AATATRGAAAGTTGCAGATGAGG | Cystic fibrosis |
| 397508200 | CFTR | NM_000492.3(CFTR): c.1393-1G>A | TTTCCARACTTCACTTCTAATGG | Cystic fibrosis |
| 387906369 | CFTR | NM_000492.3(CFTR): c.3718-1G>A | ACCTTATARGTGGGCCTCTTGGG | Cystic fibrosis |
| 397508256 | CFTR | NM_000492.3(CFTR): c.166G>A (p.Glu56Lys) | CAGARAATGGGATAGAGAGCTGG | Cystic fibrosis |
| 397508279 | CFTR | NM_000492.3(CFTR): c.170G>A (p.Trp57Ter) | CAGAGAATRGGATAGAGAGCTGG | Cystic fibrosis |
| 77409459 | CFTR | NM_000492.3(CFTR): c.1013C>T (p.Thr338Ile) | CCTCCGGAAAATATTCAYCACCA, CCGGAAAATATTCAYCACCATCT | Cystic fibrosis |
| 121908760 | CFTR | NM_000492.3(CFTR): c.2125C>T (p.Arg709Ter) | CCAATCAACTCTATAYGAAAATT | Cystic fibrosis |
| 121908802 | CFTR | NM_000492.3(CFTR): c.595C>T (p.His199Tyr) | CCAGGGACTTGCATTGGCAYATT | Cystic fibrosis |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908810 | CFTR | NM_000492.3(CFTR): c.2290C>T (p.Arg764Ter) | CCCCACGCTTCAGGCAYGAAGGA, CCACGCTTCAGGCAYGAAGGAG, CCACGCTTCAGGCAYGAAGGAGG | Cystic fibrosis |
| 374946172 | CFTR | NM_000492.3(CFTR): c.2353C>T (p.Arg785Ter) | CCAAGGTCAGAACATTCACYGAA | Cystic fibrosis |
| 121912816 | CHAT | NM_020549.4(CHAT): c.1321G>A (p.Glu441Lys) | TGCRACACTCCCCATTCGATGG | Familial infantile myasthenia |
| 121912819 | CHAT | NM_020549.4(CHAT): c.1679G>A (p.Arg560His) | TCCATCCRCCGATTCCAGGAGGG, GTCCATCCRCCGATTCCAGGAGG | Familial infantile myasthenia |
| 794727516 | CHAT | NM_020549.4(CHAT): c.418C>T (p.Gln140Ter) | CCCGTGCCCCCGCTGYAGCAGAC, CCGTGCCCCCGCTGYAGCAGACC | Familial infantile myasthenia |
| 121912821 | CHAT | NM_020549.4(CHAT): c.1493C>T (p.Ser498Leu) | CCACTTAGCCTCCTYGGCAGAAA | Familial infantile myasthenia |
| 398123000 | CHD2 | NM_001271.3(CHD2): c.1396C>T (p.Arg466Ter) | CCCTGAAGCAGAGACCAYGATTT, CCTGAAGCAGAGACCAYGATTTG | Epileptic encephalopathy, childhood-onset |
| 727503863 | CHD7 | NM_017780.3(CHD7): c.2933G>A (p.Trp978Ter) | TAAACTRGCTACTTTTCAATTGG | CHARGE association |
| 121434343 | CHD7 | NM_017780.3(CHD7): c.6322G>A (p.Gly2108Arg) | TAAACACRGGGTCAGTCGGACGG | CHARGE association |
| 587783429 | CHD7 | NM_017780.3(CHD7): c.1480C>T (p.Arg494Ter) | CCCACAAGCAATCCAGGAAYGAC, CCACAAGCAATCCAGGAAYGACT | CHARGE association |
| 727503861 | CHD7 | NM_017780.3(CHD7): c.1369C>T (p.Gln457Ter) | CCCCAGAAACATGCAGYAGTCTC | not provided |
| 587783440 | CHD7 | NM_017780.3(CHD7): c.4318C>T (p.Gln1440Ter) | CCCAGAAACATGCAGYAGTCTCG, CCAGAAACATGCAGYAGTCTCGT CCTGGATAAAGCTGTGCTAYAGT | CHARGE association |
| 587783458 | CHD7 | NM_017780.3(CHD7): c.7957C>T (p.Arg2653Ter) | CCTGTTGTCAATAAAYGAAATGG | CHARGE association |
| 786203889 | CHEK2 | NM_007194.3(CHEK2): c.278G>A (p.Trp93Ter) | TGCCCCCTRGGCTCGATTATGGG | Hereditary cancer-predisposing syndrome |
| 587781269 | CHEK2 | NM_007194.3(CHEK2): c.283C>T (p.Arg95Ter) | CCCCTGCCCCCTGGGCTYGATTA, CCCTGCCCCCTGGGCTYGATTAT, CCTGCCCCCTGGGCTYGATTATG | Hereditary cancer-predisposing syndrome |
| 17883862 | CHEK2 | NM_007194.3(CHEK2): c.254C>T (p.Pro85Leu) | CCTGAGGACCAAGAACYTGAGGA | Familial cancer of breast, Hereditary cancer-predisposing syndrome, Osteosarcoma, not specified |
| 63750355 | CHMP2B | NM_014043.3(CHMP2B): c.493C>T (p.Gln165Ter) | CCAGGATATTGTGAATYAAGTTC | Frontotemporal Dementia, Chromosome 3-Linked, not provided |
| 121912796 | CHN1 | NM_001822.5(CHN1): c.682G>A (p.Gly228Ser) | ATGTGGRGTCTCATTGCTCAGGG, TATGTGGRGTCTCATTGCTCAGG | Duane syndrome type 2 |
| 121912798 | CHN1 | NM_001822.5(CHN1): c.937G>A (p.Glu313Lys) | CCTAATTRAAGATGTCAAGATGG | Duane syndrome type 2 |
| 387906599 | CHN1 | NM_001822.5(CHN1): c.422C>T (p.Pro141Leu) | CCAAGATGACGATAAACCYAATT | Duane syndrome type 2 |
| 281865066 | CHRNA4 | NM_000744.6(CHRNA4): c.878C>T (p.Thr293Ile) | CCTGCTGCTCATCAYCGAGATCA | Epilepsy, nocturnal frontal lobe, type 1 |
| 137852810 | CHRNB1 | NM_000747.2(CHRNB1): c.865G>A (p.Val289Met) | TACTRTGTTCCTGCTGCTGCTGG | MYASTHENIC SYNDROME, CONGENITAL, 2A, SLOW-CHANNEL |
| 121912672 | CHRNG | NM_005199.4(CHRNG): c.136C>T (p.Arg46Ter) | CCTGCGGCCCGCGGAAYGAGACT | Multiple pterygium syndrome Escobar type |
| 267606725 | CHRNG | NM_005199.4(CHRNG): c.13C>T (p.Gln5Ter) | CCATGCATGGGGGCYAGGGGCCG | Multiple pterygium syndrome Escobar type |
| 267606734 | CHST3 | NM_004273.4(CHST3): c.1114G>A (p.Glu372Lys) | GCTACRAGGACGTGGCACGCGGG, CGCTACRAGGACGTGGCACGCGG | Spondyloepiphyseal dysplasia with congenital joint dislocations |
| 80356700 | CLCN1 | NM_000083.2(CLCN1): c.689G>A (p.Gly230Glu) | CGTGGRGAAAGAGGTAGGCCTGG | Myotonia congenita, Congenital myotonia, autosomal dominant form |
| 80356702 | CLCN1 | NM_000083.2(CLCN1): c.950G>A (p.Arg317Gln) | TGTTTCRAGTGCTGGCAGTGTGG | Myotonia congenita, Congenital myotonia, autosomal recessive form, Congenital myotonia, autosomal dominant form |
| 80356693 | CLCN1 | NM_000083.2(CLCN1): c.1412C>T (p.Ser471Phe) | CCAGTTCTGGATGTYCATCGTGG | Myotonia congenita |
| 80356706 | CLCN1 | NM_000083.2(CLCN1): c.2795C>T (p.Pro932Leu) | CCCCAGAGACCCTGTGCYATCT, CCCAGAGACCCTGTGCYATCTC, CCAGAGACCCTGTGCYATCTCC | Myotonia congenita, Congenital myotonia, autosomal recessive form |
| 80356694 | CLCN1 | NM_000083.2(CLCN1): c.1439C>T (p.Pro480Leu) | CCACCACTATGCCCATACYCTGC, CCACTATGCCCATACYCTGCGGA | Myotonia congenita, Congenital myotonia, autosomal dominant form |
| 201330912 | CLCN2 | NM_004366.5(CLCN2): c.1709G>A (p.Trp570Ter) | CCGTACTGGTGGCGGCCCYAGCC | Leukoencephalopathy with ataxia |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 151340625 | CLCN5 | NM_001127899.3(CLCN5): c.1727G>A (p.Gly576Glu) | GTTGRGGCTGCAGCCTGCTTAGG | |
| 121434433 | CLCN7 | NM_001287.5(CLCN7): c.2285G>A (p.Arg762Gln) | TGTTCCRGGCCCTGGGCCTGCGG | Osteopetrosis autosomal recessive 4 |
| 121434432 | CLCN7 | NM_001287.5(CLCN7): c.1663C>T (p.Gln555Ter) | CCTGATGGGAGCTGCTGCCYAGC | Osteopetrosis autosomal recessive 4 |
| 121434435 | CLCN7 | NM_001287.5(CLCN7): c.2299C>T (p.Arg767Trp) | CCGGGCCCTGGGCCTGYGGCACC | Osteopetrosis autosomal dominant type 2, Osteopetrosis autosomal recessive 4 |
| 121909132 | CLCNKB | NM_000085.4(CLCNKB): c.610G>A (p.Ala204Thr) | GGCARCGGCGGCAGTGGGCGTGG | Bartter syndrome type 3 |
| 121909136 | CLCNKB | NM_000085.4(CLCNKB): c.1830G>A (p.Trp610Ter) | CTGRGCTCCTGGACACCAGGTGG, TTCCTGRGCTCCTGGACACCAGG | Bartter syndrome, type 3, with hypocalciuria |
| 121909131 | CLCNKB | NM_000085.4(CLCNKB): c.371C>T (p.Pro124Leu) | CCAAGGTTCTGGAATCCYGGAGG | Bartter syndrome type 3 |
| 104893721 | CLDN16 | NM_006580.3(CLDN16): c.715G>A (p.Gly239Arg) | CTCRGAATGGCTGGGTCTCTGGG, GCTCRGAATGGCTGGGTCTCTGG | Primary hypomagnesemia |
| 104893723 | CLDN16 | NM_006580.3(CLDN16): c.593G>A (p.Gly198Asp) | TCAGRTACCCCAGGAATCATTGG | Primary hypomagnesemia |
| 104893727 | CLDN16 | NM_006580.3(CLDN16): c.698G>A (p.Gly233Asp) | TTTGRTTGGTCCTGTTGGCTCGG | Primary hypomagnesemia |
| 796052335 | CLN3 | NM_001042432.1(CLN3): c.949C>T (p.Gln317Ter) | CCCTGAGTCACGCTYAGCAATAC | not provided |
| 104894484 | CLN6 | NM_017882.2(CLN6): c.368G>A (p.Gly123Asp) | CATGGRTGCCAGCATCCACCTGG | Ceroid lipofuscinosis neuronal 6 |
| 796052356 | CLN6 | NM_017882.2(CLN6): c.665+1G>A | CTGRTGAGTGGACATCAGCATGG | not provided |
| 154774635 | CLN6 | NM_017882.2(CLN6): c.139C>T (p.Leu47Phe) | CCCTTCCACCTCGACYTCTGGTT, CCTTCCACCTCGACYTCTGGTTC | Adult neuronal ceroid lipofuscinosis, not provided |
| 104893615 | CNGA3 | NM_001298.2(CNGA3): c.1669G>A (p.Gly557Arg) | ACATCAAGRGGAGCAAGTCGGGG | Achromatopsia 2, not specified |
| 104893619 | CNGA3 | NM_001298.2(CNGA3): c.1585G>A (p.Val529Met) | GGCCRTGGTGGCTGATGATGGGG, TGGCCRTGGTGGCTGATGATGGG, CTGGCCRTGGTGGCTGATGATGG | Achromatopsia 2 |
| 104893613 | CNGA3 | NM_001298.2(CNGA3): c.847C>T (p.Arg283Trp) | CCGCCTACTGAAGTTTTCCYGGC, CCTACTGAAGTTTTCCYGGCTCT | Achromatopsia 2 |
| 104893620 | CNGA3 | NM_001298.2(CNGA3): c.829C>T (p.Arg277Cys) | CCCAGAAGTGAGGTTCAACYGCC, CCAGAAGTGAGGTTCAACYGCCT | Achromatopsia 2 |
| 104893621 | CNGA3 | NM_001298.2(CNGA3): c.1306C>T (p.Arg436Trp) | CCAAGGACTTGGAGACGYGGGTT | Achromatopsia 2 |
| 372504780 | CNGB1 | NM_001297.4(CNGB1): c.952C>T (p.Gln318Ter) | TCCTRGTGGGCATCCTCCCAGGG, ATCCTRGTGGGCATCCTCCCAGG | Retinitis pigmentosa 45, not provided |
| 786205909 | CNNM2 | NM_017649.4(CNNM2): c.364G>A (p.Glu122Lys) | CCTTCACCRAGCACGAGCGGCGG | HYPOMAGNESEMIA, SEIZURES, AND MENTAL RETARDATION |
| 786205910 | CNNM2 | NM_017649.4(CNNM2): c.1069G>A (p.Glu357Lys) | CTTCGGARAGATCGTGCCCCAGG | HYPOMAGNESEMIA, SEIZURES, AND MENTAL RETARDATION |
| 80100937 | CNNM4 | NM_020184.3(CNNM4): c.1690C>T (p.Gln564Ter) | CCTCCTACAGAGGTCTCTYAGTT, CCTACAGAGGTCTCTYAGTTTAG | Cone-rod dystrophy amelogenesis imperfecta |
| 398124268 | CNTNAP2 | NM_014141.5(CNTNAP2): c.2153G>A (p.Trp718Ter) | TACTRGGAGGCTCTGGGCCTGG | not provided |
| 587777136 | COASY | NM_025233.6(COASY): c.175C>T (p.Gln59Ter) | CCCCAGTCCAGCCCCGTGYAGGC, CCAGTCCAGCCCCGTGYAGGCC, CCAGTCCAGCCCCGTGYAGGCCA | Neurodegeneration with brain iron accumulation 6 |
| 267606740 | COG4 | NM_015386.2(COG4): c.2197C>T (p.Arg733Trp) | CCGAGACAAGTTTGCCYGGCTCT | Congenital disorder of glycosylation type 2J |
| 121912946 | COL11A2 | NM_080680.2(COL11A2): c.4322G>A (p.Gly1441Glu) | CCCTGRGCAGAAGGGTGAGATGG | Weissenbacher-Zweymuller syndrome |
| 121912947 | COL11A2 | NM_080680.2(COL11A2): c.3100C>T (p.Arg1034Cys) | CCCATTGGTCCGCCAGGGYGCCC, CCATTGGTCCGCCAGGGYGCCCA | Deafness, autosomal dominant 13 |
| 121912951 | COL11A2 | NM_080680.2(COL11A2): c.3991C>T (p.Arg1331Ter) | CCTGGTTCCGAGGGGYGACAAGG | |
| 200487396 | COL12A1 | NM_004370.5(COL12A1): c.5893C>T (p.Arg1965Cys) | ACAACGCRATATTGCAGCACAGG | BETHLEM MYOPATHY 2 |
| 796052094 | COL12A1 | NM_004370.5(COL12A1): c.8357G>A (p.Gly2786Asp) | CCAGRCCCCAGGGTCCTCCAGG | BETHLEM MYOPATHY 2 |
| 121912773 | COL17A1 | NM_000494.3(COL17A1): c.1898G>A (p.Gly633Asp) | CGTGRTGAGGCAGGGCCTCCTGG | Adult junctional epidermolysis bullosa |
| 121912769 | COL17A1 | NM_000494.3(COL17A1): c.3676C>T (p.Arg1226Ter) | CCTGGTCCCCAGGGCCTYGAGG | Adult junctional epidermolysis bullosa, Epidermolysis bullosa, junctional, localisata variant |
| 72648320 | COL1A1 | NM_000088.3(COL1A1): c.1200+1G>A | GCCAATRTAAGTATCCTGCCAGG | Osteogenesis imperfecta |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 72648356 | COL1A1 | NM_000088.3(COL1A1): c.1598G>A (p.Gly533Asp) | AGCTGRTCTGCCTGGTGCCAAGG | Osteogenesis imperfecta, recessive perinatal lethal |
| 72651646 | COL1A1 | NM_000088.3(COL1A1): c.2156G>A (p.Gly719Asp) | CCCGRTAGCCAGGGCGCCCCTGG | Osteogenesis imperfecta, recessive perinatal lethal |
| 72651651 | COL1A1 | NM_000088.3(COL1A1): c.2210G>A (p.Gly737Asp) | GCTGRTCTTCCAGGGCCTAAGGG, AGCTGRTCTTCCAGGGCCTAAGG | Osteogenesis imperfecta, recessive perinatal lethal |
| 72653131 | COL1A1 | NM_000088.3(COL1A1): c.2515G>A (p.Gly839Ser) | GCTRGTCCCCCTGGCCCTGCCGG | Osteogenesis imperfecta type III |
| 72653136 | COL1A1 | NM_000088.3(COL1A1): c.2533G>A (p.Gly845Arg) | GCCRGACCCGCTGGACCCCCTGG | Osteogenesis imperfecta, recessive perinatal lethal |
| 72653137 | COL1A1 | NM_000088.3(COL1A1): c.2552G>A (p.Gly851Asp) | CCCCCTGRCCCCATTGTGAGTGG | Osteogenesis imperfecta, recessive perinatal lethal |
| 72653169 | COL1A1 | NM_000088.3(COL1A1): c.3028G>A (p.Gly1010Ser) | CCCTRGTGAATCTGGACGTGAGG | Osteogenesis imperfecta with normal sclerae, dominant form |
| 72653172 | COL1A1 | NM_000088.3(COL1A1): c.3073G>A (p.Gly1025Arg) | CCTRGACGAGACGGTTCTCCTGG | Osteogenesis imperfecta, recessive perinatal lethal |
| 72653178 | COL1A1 | NM_000088.3(COL1A1): c.3118G>A (p.Gly1040Ser) | ACCRGCCCCGCTGGACCCCCTGG | Osteogenesis imperfecta type III |
| 72654797 | COL1A1 | NM_000088.3(COL1A1): c.3182G>A (p.Gly1061Asp) | GCTGRCAAGAGTGGTGATCGTGG | Osteogenesis imperfecta, recessive perinatal lethal |
| 72654802 | COL1A1 | NM_000088.3(COL1A1): c.3235G>A (p.Gly1079Ser) | GTCRGCCCTGTTGGCGCCCGTGG | Osteogenesis imperfecta type I |
| 72656306 | COL1A1 | NM_000088.3(COL1A1): c.3271G>A (p.Gly1091Ser) | CAARGCCCCCGTGGTGACAAGGG, CCAARGCCCCCGTGGTGACAAGG | Osteogenesis imperfecta, recessive perinatal lethal |
| 72656330 | COL1A1 | NM_000088.3(COL1A1): c.3541G>A (p.Gly1181Ser) | CCCRGCCCTCCTGGACCTCCTGG | Osteogenesis imperfecta, recessive perinatal lethal |
| 66523073 | COL1A1 | NM_000088.3(COL1A1): c.3064G>A (p.Gly1022Ser) | GAARGTTCCCCTGGACGAGACGG | Osteogenesis imperfecta type III |
| 72645320 | COL1A1 | NM_000088.3(COL1A1): c.761G>A (p.Gly254Glu) | CGAGRATTGCCCGGAACAGCTGG | Osteogenesis imperfecta type III |
| 72645333 | COL1A1 | NM_000088.3(COL1A1): c.824G>A (p.Gly275Asp) | GATGRTGCCAAGGGAGATGCTGG | Osteogenesis imperfecta, recessive perinatal lethal |
| 72645357 | COL1A1 | NM_000088.3(COL1A1): c.994G>A (p.Gly332Arg) | TGCCRGGCCCCCTGTGAGTGTGG | Osteogenesis imperfecta, Osteogenesis imperfecta type III |
| 72653170 | COL1A1 | NM_000088.3(COL1A1): c.3040C>T (p.Arg1014Cys) | CCCCCTGGTGAATCTGGAYGTGA, CCCCTGGTGAATCTGGAYGTGAG, CCCTGGTGAATCTGGAYGTGAGG, CCTGGTGAATCTGGAYGTGAGGT | Infantile cortical hyperostosis |
| 72653173 | COL1A1 | NM_000088.3(COL1A1): c.3076C>T (p.Arg1026Ter) | CCGAAGGTTCCCCTGGAYGAGAC | Osteogenesis imperfecta |
| 72645347 | COL1A1 | NM_000088.3(COL1A1): c.934C>T (p.Arg312Cys) | CCTGCCTGGTGAGAGAGGTYGCC, CCTGGTGAGAGAGGTYGCCCTGG | Ehlers-Danlos syndrome, classic type |
| 72658152 | COL1A2 | NM_000089.3(COL1A2): c.1981G>A (p.Gly661Ser) | CCTRGTCTCAGAGGTGAAATTGG | Osteoporosis |
| 72658161 | COL1A2 | NM_000089.3(COL1A2): c.2099G>A (p.Gly700Asp) | GCTRGTCCTGCTGGTCCTGCTGG | Osteogenesis imperfecta type III, Osteogenesis imperfecta with normal sclerae, dominant form |
| 72658176 | COL1A2 | NM_000089.3(COL1A2): c.2251G>A (p.Gly751Ser) | AACRGTGTTGTTGGTCCCACAGG | Osteogenesis imperfecta type III |
| 72658200 | COL1A2 | NM_000089.3(COL1A2): c.2575G>A (p.Gly859Ser) | CCTRGCACTCCAGGTCCTCAGGG, TCCTRGCACTCCAGGTCCTCAGG | Osteogenesis imperfecta type III |
| 72659338 | COL1A2 | NM_000089.3(COL1A2): c.3295G>A (p.Gly1099Arg) | CCTRGACCTCCAGGTGTAAGCGG | Osteogenesis imperfecta type III |
| 121912900 | COL1A2 | NM_000089.3(COL1A2): c.2720G>A (p.Gly907Asp) | CGTGRTCCTCCTGGTGCTGTGGG, CCGTGRTCCTCCTGGTGCTGTGG | Osteogenesis imperfecta, recessive perinatal lethal |
| 121912901 | COL1A2 | NM_000089.3(COL1A2): c.1640G>A (p.Gly547Asp) | CAGGRTCCCCCTGGTCCTCCAGG | Osteogenesis imperfecta, recessive perinatal lethal |
| 121912902 | COL1A2 | NM_000089.3(COL1A2): c.2593G>A (p.Gly865Ser) | CAGRGTCTTCTTGGTGCTCCTGG | Osteogenesis imperfecta, recessive perinatal lethal |
| 121912904 | COL1A2 | NM_000089.3(COL1A2): c.2414G>A (p.Gly805Asp) | TCTGRCCCTCCTGGTCCCCCTGG | Osteogenesis imperfecta, recessive perinatal lethal |
| 121912909 | COL1A2 | NM_000089.3(COL1A2): c.1739G>A (p.Gly580Asp) | TTTGRTCTCCCTGGTCCTGCTGG | Osteogenesis imperfecta, recessive perinatal lethal |
| 121912910 | COL1A2 | NM_000089.3(COL1A2): c.1504G>A (p.Gly502Ser) | TAGRGTGATCCTGGCAAAAACGG | Osteogenesis imperfecta, recessive perinatal lethal |
| 267606741 | COL1A2 | NM_000089.3(COL1A2): c.1262G>A (p.Gly421Asp) | CCTGRTAGTCGTGGTGCAAGTGG | Osteogenesis imperfecta, recessive perinatal lethal |
| 267606742 | COL1A2 | NM_000089.3(COL1A2): c.3269G>A (p.Gly1090Asp) | CAGGRCCCCCTGGTCCCCCTGG | Osteogenesis imperfecta type III |
| 72656387 | COL1A2 | NM_000089.3(COL1A2): c.838G>A (p.Gly280Ser) | GCCRGTCCCCGTGGTGAAGTGGG, CGCCRGTCCCCGTGGTGAAGTGG | Osteogenesis imperfecta |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121912864 | COL2A1 | NM_001844.4(COL2A1): c.3220G>A (p.Gly1074Ser) | CCTRGCTCCCCTGGCCCCGCTGG | Hypochondrogenesis |
| 121912867 | COL2A1 | NM_001844.4(COL2A1): c.2320G>A (p.Gly774Ser) | AAARGCCCTGAGGGAGCCCCTGG | Hypochondrogenesis |
| 121912872 | COL2A1 | NM_001844.4(COL2A1): c.800G>A (p.Gly267Asp) | AAGGGRTCCGCCTGGTCCTCAGG | STICKLER SYNDROME, TYPE I, NONSYNDROMIC OCULAR |
| 121912877 | COL2A1 | NM_001844.4(COL2A1): c.908G>A (p.Gly303Asp) | GGCGGRTGCTCCTGGTGTGAAGG | Stickler syndrome type 1, Kniest dysplasia |
| 121912878 | COL2A1 | NM_001844.4(COL2A1): c.2905G>A (p.Gly969Ser) | GAARGTCCACCAGGTCCCCAGGG, CGAARGTCCACCAGGTCCCCAGG | Achondrogenesis type 2 |
| 121912888 | COL2A1 | NM_001844.4(COL2A1): c.1547G>A (p.Gly516Asp) | CGCGRTTTCCCAGGTCAAGATGG | Achondrogenesis type 2 |
| 121912891 | COL2A1 | NM_001844.4(COL2A1): c.3508G>A (p.Gly1170Ser) | GTCRGTCCCTCTGGCAAAGATGG | Coxa plana |
| 121912894 | COL2A1 | NM_001844.4(COL2A1): c.952G>A (p.Gly318Arg) | GAACRGATCTCCGGGCCCAATGG | Rhegmatogenous retinal detachment, autosomal dominant |
| 121912896 | COL2A1 | NM_001844.4(COL2A1): c.141G>A (p.Trp47Ter) | TGTGRAAGCCGGAGCCCTGCCGG | STICKLER SYNDROME, TYPE I, NONSYNDROMIC OCULAR |
| 138498898 | COL2A1 | NM_001844.4(COL2A1): c.4148C>T (p.Thr1383Met) | CTTCCRTGGACAGCAGGCGTAGG | |
| 121912868 | COL2A1 | NM_001844.4(COL2A1): c.3158G>A (p.Gly1053Glu) | CTGRAGTCAAGGTGAGTGTCTGG | Hypochondrogenesis |
| 387906558 | COL2A1 | NM_001844.4(COL2A1): c.2149G>A (p.Gly717Ser) | CAGRGTCCCCGTGGCCTCCCCGG | |
| 121912865 | COL2A1 | NM_001844.4(COL2A1): c.2155C>T (p.Arg719Cys) | CCAGGGCCTCCAGGGTCCCYGTG | Osteoarthritis with mild chondrodysplasia |
| 121912882 | COL2A1 | NM_001844.4(COL2A1): c.2710C>T (p.Arg904Cys) | CCCTGGAGCTGCTGGCYGCGTTG, CCTGGAGCTGCTGGCYGCGTTGG | Epiphyseal dysplasia, multiple, with myopia and conductive deafness |
| 113871730 | COL3A1 | NM_000090.3(COL3A1): c.926G>A (p.Gly309Glu) | GAGRACGGCCAGGACTTCCTGGG, CGAGRACGGCCAGGACTTCCTGG | Ehlers-Danlos syndrome, type 4 |
| 113485686 | COL3A1 | NM_000090.3(COL3A1): c.2356G>A (p.Gly786Arg) | CCCRGACTTCCAGGTATAGCTGG | Ehlers-Danlos syndrome, type 4, Ehlers-Danlos syndrome, type 4 variant |
| 121912916 | COL3A1 | NM_000090.3(COL3A1): c.3041G>A (p.Gly1014Glu) | CAGGRAAACCCTGGATCAGATGG | Ehlers-Danlos syndrome, type 4 |
| 121912919 | COL3A1 | NM_000090.3(COL3A1): c.907G>A (p.Gly303Arg) | AGARGGGCTCCTGGTGAGCGAGG | Ehlers-Danlos syndrome, type 4 |
| 121912920 | COL3A1 | NM_000090.3(COL3A1): c.2410G>A (p.Gly804Ser) | ACTRGCCCTCCAGGACCTGCTGG | |
| 121912921 | COL3A1 | NM_000090.3(COL3A1): c.1997G>A (p.Gly666Asp) | GCCGRTGCACCTGGAGCTCCAGG | Ehlers-Danlos syndrome, type 4 |
| 121912924 | COL3A1 | NM_000090.3(COL3A1): c.3302G>A (p.Gly1101Glu) | CGTGRAGCTGCTGGCATCAAAGG | Ehlers-Danlos syndrome, type 4 |
| 587779419 | COL3A1 | NM_000090.3(COL3A1): c.1033G>A (p.Gly345Arg) | CCCTRGATCCCCTGGTGCTAAGG | Ehlers-Danlos syndrome, type 4 |
| 587779432 | COL3A1 | NM_000090.3(COL3A1): c.2780G>A (p.Gly927Asp) | GCTGRCCAACCAGGAGAGAAGGG, TGCTGRCCAACCAGGAGAGAAGG | Ehlers-Danlos syndrome, type 4 |
| 587779434 | COL3A1 | NM_000090.3(COL3A1): c.2861G>A (p.Gly954Glu) | ACTGRAGCACGGGGTCTTGCAGG | Ehlers-Danlos syndrome, type 4 |
| 587779437 | COL3A1 | NM_000090.3(COL3A1): c.2140G>A (p.Gly714Arg) | CCTRGGCCACCTGGTGCTGCTGG | Ehlers-Danlos syndrome, type 4 |
| 587779438 | COL3A1 | NM_000090.3(COL3A1): c.2824G>A (p.Gly942Arg) | TAGRGAGCTCCAGGCCCACTTGG | Ehlers-Danlos syndrome, type 4 |
| 587779439 | COL3A1 | NM_000090.3(COL3A1): c.3301G>A (p.Gly1101Arg) | CGTRGAGCTGCTGGCATCAAAGG | Ehlers-Danlos syndrome, type 4 |
| 587779446 | COL3A1 | NM_000090.3(COL3A1): c.556G>A (p.Gly186Ser) | CCTRGTACATCTGGTCATCCTGG | Ehlers-Danlos syndrome, type 4 |
| 587779447 | COL3A1 | NM_000090.3(COL3A1): c.2842G>A (p.Gly948Arg) | CTTRGGATTGCTGGGATCACTGG | Ehlers-Danlos syndrome, type 4 |
| 587779456 | COL3A1 | NM_000090.3(COL3A1): c.2978G>A (p.Gly993Asp) | CGTGRTCCCCTGGACCCCAGGG, ACGTGRTCCCCTGGACCCCAGG | Ehlers-Danlos syndrome, type 4 |
| 587779466 | COL3A1 | NM_000090.3(COL3A1): c.2564G>A (p.Gly855Asp) | CCTGRTCCCCAAGGTGTCAAAGG | Ehlers-Danlos syndrome, type 4 |
| 587779472 | COL3A1 | NM_000090.3(COL3A1): c.3473G>A (p.Gly1158Asp) | CAGRTCCCATTGGACCACCAGGG, CCAGRTCCCATTGGACCACCAGG | Ehlers-Danlos syndrome, type 4 |
| 587779474 | COL3A1 | NM_000090.3(COL3A1): c.2068G>A (p.Gly690Arg) | GCARGGGCCCCAGGACTTAGAGG | Ehlers-Danlos syndrome, type 4 |
| 587779476 | COL3A1 | NM_000090.3(COL3A1): c.1466G>A (p.Gly489Glu) | CCTGRGTTCCGAGGACCTGCTGG | Ehlers-Danlos syndrome, type 4 |
| 587779478 | COL3A1 | NM_000090.3(COL3A1): c.809G>A (p.Gly270Glu) | GATGRACGAAATGGAGAAAAGGG, CGATGRACGAAATGGAGAAAAGG | Ehlers-Danlos syndrome, type 4 |
| 587779482 | COL3A1 | NM_000090.3(COL3A1): c.3508G>A (p.Gly1170Ser) | CAGARGTGAAAGAGGATCTGAGG | Ehlers-Danlos syndrome, type 4 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587779484 | COL3A1 | NM_000090.3(COL3A1): c.2203G>A (p.Gly735Arg) | CTTRGAAGTCCTGGTCCAAAGGG, TCTTRGAAGTCCTGGTCCAAAGG | Ehlers-Danlos syndrome, type 4 |
| 587779493 | COL3A1 | NM_000090.3(COL3A1): c.1979G>A (p.Gly660Asp) | CAGGRTCCAAAGGGTGATGCCGG | Ehlers-Danlos syndrome, type 4 |
| 587779494 | COL3A1 | NM_000090.3(COL3A1): c.2555G>A (p.Gly852Asp) | TAGGRTCCTCCTGGTCCCCAAGG | Ehlers-Danlos syndrome, type 4 |
| 587779495 | COL3A1 | NM_000090.3(COL3A1): c.3437G>A (p.Gly1146Glu) | AGTGRACCTCCTGGCAAAGATGG | Ehlers-Danlos syndrome, type 4 |
| 587779499 | COL3A1 | NM_000090.3(COL3A1): c.1087G>A (p.Gly363Ser) | AATRGTGCCCCTGGACAAAGAGG | Ehlers-Danlos syndrome, type 4 |
| 587779501 | COL3A1 | NM_000090.3(COL3A1): c.3255+5G>A (p.Gly1068_Pro1085del) | CTGTAARTTTTGTCATTTTTTGG | Ehlers-Danlos syndrome, type 4 |
| 587779504 | COL3A1 | NM_000090.3(COL3A1): c.3562G>A (p.Gly1188Arg) | CCTRGACCTCCTGGTGCCCCTGG | Ehlers-Danlos syndrome, type 4 |
| 587779505 | COL3A1 | NM_000090.3(COL3A1): c.2708G>A (p.Gly903Glu) | GATGRGCCCCAGGTCCTGCGGG, GGATGRGCCCCAGGTCCTGCGG | Ehlers-Danlos syndrome, type 4 |
| 587779511 | COL3A1 | NM_000090.3(COL3A1): c.2888G>A (p.Gly963Asp) | CCAGRCATGCCAGGTCCTAGGGG, ACCAGRCATGCCAGGTCCTAGGG, CACCAGRCATGCCAGGTCCTAGG | Ehlers-Danlos syndrome, type 4 |
| 587779517 | COL3A1 | NM_000090.3(COL3A1): c.2825G>A (p.Gly942Glu) | AGGRAGCTCCAGGCCCACTTGGG, TAGGRAGCTCCAGGCCCACTTGG | Ehlers-Danlos syndrome, type 4 |
| 587779526 | COL3A1 | NM_000090.3(COL3A1): c.2510G>A (p.Gly837Asp) | GGAGRCCCTCCTGGAGTTGCAGG | Ehlers-Danlos syndrome, type 4 |
| 587779536 | COL3A1 | NM_000090.3(COL3A1): c.3391G>A (p.Gly1131Ser) | ATCRGCAGTCCAGGACCTGCAGG | Ehlers-Danlos syndrome, type 4 |
| 587779538 | COL3A1 | NM_000090.3(COL3A1): c.1149+5G>A (p.Gly351_Pro383del) | TGTAARTATCATAGTTGAGAGGG, CTGTAARTATCATAGTTGAGAGG | Ehlers-Danlos syndrome, type 4 |
| 587779540 | COL3A1 | NM_000090.3(COL3A1): c.3167G>A (p.Gly1056Asp) | GTCGRTCCAGCTGGAAAGAGTGG | Ehlers-Danlos syndrome, type 4 |
| 587779543 | COL3A1 | NM_000090.3(COL3A1): c.2185G>A (p.Gly729Arg) | CCTRGAGAAAGAGGAGGTCTTGG | Ehlers-Danlos syndrome, type 4 |
| 587779545 | COL3A1 | NM_000090.3(COL3A1): c.3140G>A (p.Gly1047Asp) | CCTGRTCATCCAGGCCCACCTGG | Ehlers-Danlos syndrome, type 4 |
| 587779549 | COL3A1 | NM_000090.3(COL3A1): c.2150G>A (p.Gly717Asp) | CCTGRTGCTGCTGGTACTCCTGG | Ehlers-Danlos syndrome, type 4 |
| 587779554 | COL3A1 | NM_000090.3(COL3A1): c.3220G>A (p.Gly1074Ser) | GCTRGTGCTCCCGGTCCTGCTGG | Ehlers-Danlos syndrome, type 4 |
| 587779557 | COL3A1 | NM_000090.3(COL3A1): c.637G>A (p.Gly213Ser) | CAGRGCCCTCCAGGACCTCCTGG | Ehlers-Danlos syndrome, type 4 |
| 587779561 | COL3A1 | NM_000090.3(COL3A1): c.3319G>A (p.Gly1107Arg) | AAARGACATCGAGGATTCCCTGG | Ehlers-Danlos syndrome, type 4 |
| 587779567 | COL3A1 | NM_000090.3(COL3A1): c.2833G>A (p.Gly945Ser) | CCARGCCCACTTGGGATTGCTGG | Ehlers-Danlos syndrome, type 4 |
| 587779569 | COL3A1 | NM_000090.3(COL3A1): c.1124G>A (p.Gly375Glu) | CAGGRACACGCTGGTGCTCAAGG | Ehlers-Danlos syndrome, type 4 |
| 587779576 | COL3A1 | NM_000090.3(COL3A1): c.2987G>A (p.Gly996Glu) | CCTGRACCCCAGGGTCTTCCTGG | Ehlers-Danlos syndrome, type 4 |
| 587779580 | COL3A1 | NM_000090.3(COL3A1): c.2905G>A (p.Gly969Arg) | AGGRGAAGCCCTGGCCCTCAGGG, TAGGRGAAGCCCTGGCCCTCAGG | Ehlers-Danlos syndrome, type 4 |
| 587779581 | COL3A1 | NM_000090.3(COL3A1): c.2168G>A (p.Gly723Asp) | CCTGRTCTGCAAGGAATGCCTGG | Ehlers-Danlos syndrome, type 4 |
| 587779583 | COL3A1 | NM_000090.3(COL3A1): c.2959G>A (p.Gly987Ser) | AACRGTCTCAGTGGAGAACGTGG | Thoracic aortic aneurysms and aortic dissections, Ehlers-Danlos syndrome, type 4 |
| 587779584 | COL3A1 | NM_000090.3(COL3A1): c.1618G>A (p.Gly540Arg) | CCCRGAAGTCCAGGAGGACCAGG | Thoracic aortic aneurysms and aortic dissections, Ehlers-Danlos syndrome, type 4 |
| 587779586 | COL3A1 | NM_000090.3(COL3A1): c.1268G>A (p.Gly423Asp) | AATRGTGCTCCTGGACTGCGAGG | Ehlers-Danlos syndrome, type 4 |
| 587779591 | COL3A1 | NM_000090.3(COL3A1): c.2087G>A (p.Gly696Asp) | AGAGRTGGAGCTGGTCCCCCTGG | Ehlers-Danlos syndrome, type 4 |
| 587779593 | COL3A1 | NM_000090.3(COL3A1): c.836G>A (p.Gly279Asp) | AACAGRTGCTCCTGGATTAAAGG | Ehlers-Danlos syndrome, type 4 |
| 587779595 | COL3A1 | NM_000090.3(COL3A1): c.2933G>A (p.Gly978Asp) | CAGGRTGAAAGTGGGAAACCAGG | Ehlers-Danlos syndrome, type 4 |
| 587779596 | COL3A1 | NM_000090.3(COL3A1): c.647G>A (p.Gly216Glu) | CCAGRACCTCCTGGTGCTATAGG | Ehlers-Danlos syndrome, type 4 |
| 587779599 | COL3A1 | NM_000090.3(COL3A1): c.2699G>A (p.Gly900Asp) | CCAGRCAAGGATGGGCCCCAGG | Ehlers-Danlos syndrome, type 4 |
| 587779601 | COL3A1 | NM_000090.3(COL3A1): c.592G>A (p.Gly198Arg) | CCARGATACCAAGGACCCCCTGG | Ehlers-Danlos syndrome, type 4 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587779606 | COL3A1 | NM_000090.3(COL3A1): c.2194G>A (p.Gly732Arg) | AGARGAGGTCTTGGAAGTCCTGG | Ehlers-Danlos syndrome, type 4 |
| 587779610 | COL3A1 | NM_000090.3(COL3A1): c.3284G>A (p.Gly1095Asp) | AAAGRTGAAACAGGTGAACGTGG | Ehlers-Danlos syndrome, type 4 |
| 587779611 | COL3A1 | NM_000090.3(COL3A1): c.1898G>A (p.Gly633Glu) | ACAGRACCCCCTGGTCCACAAGG | Ehlers-Danlos syndrome, type 4 |
| 587779621 | COL3A1 | NM_000090.3(COL3A1): c.1358G>A (p.Gly453Asp) | GCTGRTATTCCAGGTGTTCCAGG | Ehlers-Danlos syndrome, type 4 |
| 587779625 | COL3A1 | NM_000090.3(COL3A1): c.709G>A (p.Gly237Arg) | CCCRGACGACCTGGAGAGCGAGG | Thoracic aortic aneurysms and aortic dissections, Ehlers-Danlos syndrome, type 4 |
| 587779626 | COL3A1 | NM_000090.3(COL3A1): c.611G>A (p.Gly204Asp) | CCTGRTGAACCTGGGCAAGCTGG | Ehlers-Danlos syndrome, type 4 |
| 587779630 | COL3A1 | NM_000090.3(COL3A1): c.2293G>A (p.Gly765Ser) | ACTRGTCCTATTGGTCCTCCTGG | Ehlers-Danlos syndrome, type 4 |
| 587779631 | COL3A1 | NM_000090.3(COL3A1): c.1267G>A (p.Gly423Ser) | AATRGTGCTCCTGGACTGCGAGG | Ehlers-Danlos syndrome, type 4 |
| 587779633 | COL3A1 | NM_000090.3(COL3A1): c.1384G>A (p.Gly462Ser) | AAARGCGAAGATGGCAAGGATGG, AGCTAAARGCGAAGATGGCAAGG | Ehlers-Danlos syndrome, type 4 |
| 587779634 | COL3A1 | NM_000090.3(COL3A1): c.1844G>A (p.Gly615Glu) | CTGRACCTCAGGGACCCCCAGGG, ACTGRACCTCAGGGACCCCCAGG | Ehlers-Danlos syndrome, type 4 |
| 587779637 | COL3A1 | NM_000090.3(COL3A1): c.1249G>A (p.Gly417Arg) | CCARGACCAGCCGGTGCTAATGG | Ehlers-Danlos syndrome, type 4 |
| 587779638 | COL3A1 | NM_000090.3(COL3A1): c.2176G>A (p.Gly726Arg) | CAARGAATGCCTGGAGAAAGAGG | Ehlers-Danlos syndrome, type 4 |
| 587779641 | COL3A1 | NM_000090.3(COL3A1): c.593G>A (p.Gly198Glu) | CCAGRATACCAAGGACCCCCTGG | Ehlers-Danlos syndrome, type 4 |
| 587779642 | COL3A1 | NM_000090.3(COL3A1): c.2501G>A (p.Gly834Asp) | AAAGRTGAAGGAGGCCCTCCTGG | Ehlers-Danlos syndrome, type 4 |
| 587779644 | COL3A1 | NM_000090.3(COL3A1): c.827G>A (p.Gly276Asp) | AAGGRTGAAACAGGTGCTCCTGG | Ehlers-Danlos syndrome, type 4 |
| 587779648 | COL3A1 | NM_000090.3(COL3A1): c.3419G>A (p.Gly1140Glu) | TAGGRACCTGTTGGACCCAGTGG | Ehlers-Danlos syndrome, type 4 |
| 587779650 | COL3A1 | NM_000090.3(COL3A1): c.970G>A (p.Gly324Ser) | GACRGTGCTCGAGGCAGTGATGG | Ehlers-Danlos syndrome, type 4 |
| 587779656 | COL3A1 | NM_000090.3(COL3A1): c.701G>A (p.Gly234Asp) | TCAGRTAGACCCGGACGACCTGG | Ehlers-Danlos syndrome, type 4 |
| 587779662 | COL3A1 | NM_000090.3(COL3A1): c.2753G>A (p.Gly918Glu) | CCTGRAGTGTCTGACCAAAAGG | Ehlers-Danlos syndrome, type 4 |
| 587779672 | COL3A1 | NM_000090.3(COL3A1): c.3266G>A (p.Gly1089Asp) | CAAGRCCCACGTGGTGACAAAGG | Ehlers-Danlos syndrome, type 4 |
| 587779673 | COL3A1 | NM_000090.3(COL3A1): c.998G>A (p.Gly333Asp) | CAGGRCCCTCCTGGTCCTCCTGG | Ehlers-Danlos syndrome, type 4 |
| 587779674 | COL3A1 | NM_000090.3(COL3A1): c.2860G>A (p.Gly954Arg) | ACTRGAGCACGGGGTCTTGCAGG | Ehlers-Danlos syndrome, type 4 |
| 587779678 | COL3A1 | NM_000090.3(COL3A1): c.2141G>A (p.Gly714Glu) | CCTGRGCCACCTGGTGCTGCTGG | Ehlers-Danlos syndrome, type 4 |
| 587779680 | COL3A1 | NM_000090.3(COL3A1): c.2186G>A (p.Gly729Glu) | CCTGRAGAAAGAGGAGGTCTTGG | Ehlers-Danlos syndrome, type 4 |
| 587779683 | COL3A1 | NM_000090.3(COL3A1): c.3544G>A (p.Gly1182Arg) | CCARGGCAACCAGGCCCTCCTGG | Ehlers-Danlos syndrome, type 4 |
| 587779689 | COL3A1 | NM_000090.3(COL3A1): c.2402G>A (p.Gly801Asp) | AGAGRTGAAACTGGCCCTCCAGG | Ehlers-Danlos syndrome, type 4 |
| 587779691 | COL3A1 | NM_000090.3(COL3A1): c.1763G>A (p.Gly588Asp) | TAGGRTGCTCCTGGTAAGAATGG | Ehlers-Danlos syndrome, type 4 |
| 587779692 | COL3A1 | NM_000090.3(COL3A1): c.1258G>A (p.Gly420Ser) | GCCRGTGCTAATGGTGCTCCTGG | Ehlers-Danlos syndrome, type 4 |
| 587779693 | COL3A1 | NM_000090.3(COL3A1): c.1556G>A (p.Gly519Glu) | AGAGRAGCTGCTGGAGAACCTGG | Ehlers-Danlos syndrome, type 4 |
| 587779695 | COL3A1 | NM_000090.3(COL3A1): c.2131G>A (p.Gly711Ser) | GCTRGTCCTCCTGGGCCACCTGG | Ehlers-Danlos syndrome, type 4 |
| 587779696 | COL3A1 | NM_000090.3(COL3A1): c.1096G>A (p.Gly366Arg) | CCTRGACAAAGAGGAGAACCTGG | Ehlers-Danlos syndrome, type 4 |
| 587779698 | COL3A1 | NM_000090.3(COL3A1): c.2177G>A (p.Gly726Glu) | CAAGRAATGCCTGGAGAAAGAGG | Ehlers-Danlos syndrome, type 4 |
| 587779706 | COL3A1 | NM_000090.3(COL3A1): c.2096G>A (p.Gly699Asp) | GCTGRTCCCCTGGTCCCGAAGG | Ehlers-Danlos syndrome, type 4 |
| 587779711 | COL3A1 | NM_000090.3(COL3A1): c.610G>A (p.Gly204Ser) | CCTRGTGAACCTGGGCAAGCTGG | Ehlers-Danlos syndrome, type 4 |
| 587779714 | COL3A1 | NM_000090.3(COL3A1): c.539G>A (p.Gly180Asp) | CCAGRCCCTCCCGGTCCCCCTGG | Ehlers-Danlos syndrome, type 4 |
| 587779716 | COL3A1 | NM_000090.3(COL3A1): c.2735G>A (p.Gly912Asp) | ACTGRTGCTCCTGGCAGCCCTGG | Ehlers-Danlos syndrome, type 4 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587779718 | COL3A1 | NM_000090.3(COL3A1): c.799G>A (p.Gly267Ser) | TAGRGCTTCGATGGACGAAATGG | Ehlers-Danlos syndrome, type 4 |
| 587779723 | COL3A1 | NM_000090.3(COL3A1): c.2914G>A (p.Gly972Ser) | CCCTRGCCCTCAGGGTGTCAAGG | Ehlers-Danlos syndrome, type 4 |
| 112456072 | COL3A1 | NM_000090.3(COL3A1): c.3563G>A (p.Gly1188Glu) | CCTGRACCTCCTGGTGCCCCTGG | Ehlers-Danlos syndrome, type 4 |
| 794728060 | COL3A1 | NM_000090.3(COL3A1): c.4087C>T (p.Arg1363Ter) | CCTTCGACTTCTCTCCAGCYGAG | Thoracic aortic aneurysms and aortic dissections |
| 587779527 | COL3A1 | NM_000090.3(COL3A1): c.1786C>T (p.Arg596Ter) | CCTGGTAAGAATGGAGAAYGAGG | Ehlers-Danlos syndrome, type 4 |
| 672601346 | COL4A1 | NM_001845.5(COL4A1): c.2263G>A (p.Gly755Arg) | CCCRGGGAGAAGGGGAGCATTGG | Brain small vessel disease with hemorrhage |
| 672601349 | COL4A1 | NM_001845.5(COL4A1): c.2122G>A (p.Gly708Arg) | ATGRGGCCACCGGGGACTCCAGG | Brain small vessel disease with hemorrhage |
| 121912857 | COL4A1 | NM_001845.5(COL4A1): c.1685G>A (p.Gly562Glu) | CCTGRAAGAGATGGCCATCCGGG, TCCTGRAAGAGATGGCCATCCGG | Brain small vessel disease with hemorrhage |
| 606231465 | COL4A1 | NM_001845.5(COL4A1): c.2194-1G>A | TTTCARGGAGAGCCTGGAGTTGG | Brain small vessel disease with hemorrhage |
| 113994105 | COL4A1 | NM_001845.5(COL4A1): c.1555G>A (p.Gly519Arg) | CCARGGCTGATAGGCCAGCCAGG | Angiopathy, hereditary, with nephropathy, aneurysms, and muscle cramps |
| 113994107 | COL4A1 | NM_001845.5(COL4A1): c.1769G>A (p.Gly590Glu) | CCTGGAGRAGTTGGATTCCCAGG | Brain small vessel disease with hemorrhage |
| 113994108 | COL4A1 | NM_001845.5(COL4A1): c.2159G>A (p.Gly720Asp) | AATGRCTTACCTGGGAACCCAGG | Brain small vessel disease with hemorrhage |
| 113994109 | COL4A1 | NM_001845.5(COL4A1): c.2245G>A (p.Gly749Ser) | CCCRGCATTCCTGGCACACCCGG | Familial porencephaly |
| 113994111 | COL4A1 | NM_001845.5(COL4A1): c.3389G>A (p.Gly1130Asp) | CCTGRTGTCAAAGGAGAAGCAGG | Familial porencephaly |
| 113994112 | COL4A1 | NM_001845.5(COL4A1): c.3706G>A (p.Gly1236Arg) | AAARGAGACCGCGGACCTCAGGG, CAAARGAGACCGCGGACCTCAGG | Familial porencephaly |
| 587777379 | COL4A1 | NM_001845.5(COL4A1): c.3976G>A (p.Gly1326Arg) | CCTTGATCACCTTTAATTCYCTG | Schizencephaly |
| 387906602 | COL4A2 | NM_001846.2(COL4A2): c.3455G>A (p.Gly1152Asp) | CAGRCTTTCCAGGGCTGACTGGG, CCAGRCTTTCCAGGGCTGACTGG | Porencephaly 2 |
| 387906603 | COL4A2 | NM_001846.2(COL4A2): c.3110G>A (p.Gly1037Glu) | AAGGRAGACATCGGAGTCCCCGG | Porencephaly 2 |
| 121912858 | COL4A4 | NM_000092.4(COL4A4): c.3601G>A (p.Gly1201Ser) | CCTGTCCAGTGGGAATACCTGG | Alport syndrome, autosomal recessive |
| 121912860 | COL4A4 | NM_000092.4(COL4A4): c.2690G>A (p.Gly897Glu) | GATGRGCTACCTGGTCCTCCAGG | Benign familial hematuria |
| 281874656 | COL4A5 | NM_000495.4(COL4A5): c.1084G>A (p.Gly362Arg) | ATTRGGTTGCCTGGGTTGCCTGG | Alport syndrome, X-linked recessive |
| 281874660 | COL4A5 | NM_000495.4(COL4A5): c.1216G>A (p.Gly406Ser) | AGGRGTCAGAAAGGTGATGAAGG | Alport syndrome, X-linked recessive |
| 281874663 | COL4A5 | NM_000495.4(COL4A5): c.1259G>A (p.Gly420Glu) | CCTGRACCTCCTGGACTTGACGG | Alport syndrome, X-linked recessive |
| 281874664 | COL4A5 | NM_000495.4(COL4A5): c.1294G>A (p.Gly432Arg) | CCTRGGCTTCCAGGGCCTCCTGG | Alport syndrome, X-linked recessive |
| 281874669 | COL4A5 | NM_000495.4(COL4A5): c.142G>A (p.Gly48Arg) | CAGRGAGAGAGAGGGTTTCCAGG | Alport syndrome, X-linked recessive |
| 281874671 | COL4A5 | NM_000495.4(COL4A5): c.1589G>A (p.Gly530Asp) | CAGGRCATTCCAGGAGCTCCAGG | Alport syndrome, X-linked recessive |
| 281874672 | COL4A5 | NM_000495.4(COL4A5): c.1598G>A (p.Gly533Glu) | CCAGRAGCTCCAGGTGCTCCAGG | Alport syndrome, X-linked recessive |
| 281874675 | COL4A5 | NM_000495.4(COL4A5): c.1726G>A (p.Gly576Ser) | CCTRGCACTCCTGGACAGGATGG, TTTACCTRGCACTCCTGGACAGG | Alport syndrome, X-linked recessive |
| 281874677 | COL4A5 | NM_000495.4(COL4A5): c.1744G>A (p.Gly582Arg) | GATRGATTGCCAGGGCTTCCTGG | Alport syndrome, X-linked recessive |
| 281874680 | COL4A5 | NM_000495.4(COL4A5): c.1835G>A (p.Gly612Asp) | CAGRCCTCCCAGGGAATATAGGG, CCAGRCCTCCCAGGGAATATAGG | Alport syndrome, X-linked recessive |
| 281874683 | COL4A5 | NM_000495.4(COL4A5): c.1904G>A (p.Gly635Asp) | AAAGRCATACAAGGTGTGGCAGG, TGAAAAAGRCATACAAGGTGTGG | Alport syndrome, X-linked recessive |
| 281874689 | COL4A5 | NM_000495.4(COL4A5): c.2288G>A (p.Gly763Glu) | CCAGRACTTCCAGGTTTCAAAGG | Alport syndrome, X-linked recessive |
| 281874690 | COL4A5 | NM_000495.4(COL4A5): c.2305G>A (p.Gly769Arg) | AAARGAGCACTTGGTCCAAAAGG | Alport syndrome, X-linked recessive |
| 281874695 | COL4A5 | NM_000495.4(COL4A5): c.2483G>A (p.Gly828Glu) | CCAGRGATTCCTGGGCCAATAGG | Alport syndrome, X-linked recessive |
| 281874703 | COL4A5 | NM_000495.4(COL4A5): c.2722G>A (p.Gly908Arg) | CCARGACCTTTGGGAATTCCTGG | Alport syndrome, X-linked recessive |
| 281874704 | COL4A5 | NM_000495.4(COL4A5): c.2731G>A (p.Gly911Arg) | TTGRGAATTCCTGGCAGGAGTGG, GACCTTTGRGAATTCCTGGCAGG | Alport syndrome, X-linked recessive |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 281874706 | COL4A5 | NM_000495.4(COL4A5):c.286G>A (p.Gly96Arg) | CCTRGACTTCCTGGATTTCCAGG | Alport syndrome, X-linked recessive |
| 281874717 | COL4A5 | NM_000495.4(COL4A5):c.3587G>A (p.Gly1196Glu) | CCTGRACTTCCAGGACTTTCTGG | Alport syndrome, X-linked recessive |
| 281874722 | COL4A5 | NM_000495.4(COL4A5):c.385G>A (p.Gly129Arg) | TAGRGAGAACGTGGATTTCCAGG | Alport syndrome, X-linked recessive |
| 281874725 | COL4A5 | NM_000495.4(COL4A5):c.3925-1G>A | TCARGGTAATCCTGGCCGGCCGG, TTATTCARGGTAATCCTGGCCGG | Alport syndrome, X-linked recessive |
| 281874733 | COL4A5 | NM_000495.4(COL4A5):c.4271G>A (p.Gly1424Glu) | AAAGRAGACCCAGGTCTGCCAGG | Alport syndrome, X-linked recessive |
| 281874739 | COL4A5 | NM_000495.4(COL4A5):c.438+5G>A | TCCAGTAARTTATAAAATTTGGG | Alport syndrome, X-linked recessive |
| 281874746 | COL4A5 | NM_000495.4(COL4A5):c.4702G>A (p.Glu1568Lys) | AGTATGTRAAGCTCCAGCTGTGG | Alport syndrome, X-linked recessive |
| 281874763 | COL4A5 | NM_000495.4(COL4A5):c.689G>A (p.Gly230Asp) | CAGGRTGAGCAAGGTCTTCAGGG, ACAGGRTGAGCAAGGTCTTCAGG | Alport syndrome, X-linked recessive |
| 104886080 | COL4A5 | NM_000495.4(COL4A5):c.892G>A (p.Gly298Ser) | TAGRGTAAACCAGGCAAAGATGG | Alport syndrome, X-linked recessive |
| 104886381 | COL4A5 | NM_000495.4(COL4A5):c.3554-1G>A | CTGACARGTCAACCAGGCTTTGG | Alport syndrome, X-linked recessive |
| 587776402 | COL4A5 | NM_000495.4(COL4A5):c.4199-1G>A | GTARGTCCAACTGGCCCTCCAGG | Alport syndrome, X-linked recessive |
| 104886043 | COL4A5 | NM_000495.4(COL4A5):c.161G>A (p.Gly54Asp) | CCAGRTTTGGAAGGACACCCAGG | Alport syndrome, X-linked recessive |
| 104886057 | COL4A5 | NM_000495.4(COL4A5):c.593G>A (p.Gly198Glu) | CCCAGRACCACCAGGTTTGATGG | Alport syndrome, X-linked recessive |
| 104886060 | COL4A5 | NM_000495.4(COL4A5):c.574G>A (p.Gly192Arg) | CCARGGCCAATTGGTCCCCCAGG | Alport syndrome, X-linked recessive |
| 104886061 | COL4A5 | NM_000495.4(COL4A5):c.584G>A (p.Gly195Asp) | ATTGRTCCCCCAGGACCACCAGG | Alport syndrome, X-linked recessive |
| 104886070 | COL4A5 | NM_000495.4(COL4A5):c.791G>A (p.Gly264Asp) | CCTGRTGACCGAGGGCCTCCTGG | Alport syndrome, X-linked recessive |
| 104886075 | COL4A5 | NM_000495.4(COL4A5):c.655G>A (p.Gly219Ser) | AATATGRGCTTAAATTTCCAGGG, GAATATGRGCTTAAATTTCCAGG | Alport syndrome, X-linked recessive |
| 104886084 | COL4A5 | NM_000495.4(COL4A5):c.937G>A (p.Gly313Ser) | AAGRGTTTGCCTGGTGATCCTGG | Alport syndrome, X-linked recessive |
| 104886086 | COL4A5 | NM_000495.4(COL4A5):c.956G>A (p.Gly319Asp) | CCTGRTTACCCTGGTGAACCCGG | Alport syndrome, X-linked recessive |
| 104886091 | COL4A5 | NM_000495.4(COL4A5):c.974G>A (p.Gly325Glu) | ACCCGRAAGGGATGGTGAAAAGG | Alport syndrome, X-linked recessive |
| 104886096 | COL4A5 | NM_000495.4(COL4A5):c.1094G>A (p.Gly365Glu) | CCTGRGTTGCCTGGAGAAAAAGG | Alport syndrome, X-linked recessive |
| 104886097 | COL4A5 | NM_000495.4(COL4A5):c.1112G>A (p.Gly371Glu) | AAAGRAGAGCGAGGATTTCCTGG | Alport syndrome, X-linked recessive |
| 104886098 | COL4A5 | NM_000495.4(COL4A5):c.1139G>A (p.Gly380Asp) | CAGGRTCCACCTGGCCTTCCTGG | Alport syndrome, X-linked recessive |
| 104886101 | COL4A5 | NM_000495.4(COL4A5):c.1226G>A (p.Gly409Asp) | AAAGRTGATGAAGGACCACCTGG | Alport syndrome, X-linked recessive |
| 104886103 | COL4A5 | NM_000495.4(COL4A5):c.1243G>A (p.Gly415Arg) | CCACCTRGAATTTCCATTCCTGG | Alport syndrome, X-linked recessive |
| 104886105 | COL4A5 | NM_000495.4(COL4A5):c.1148G>A (p.Gly383Asp) | CCTGRCCTTCCTGGACCTCCAGG | Alport syndrome, X-linked recessive |
| 104886107 | COL4A5 | NM_000495.4(COL4A5):c.1199G>A (p.Gly400Glu) | CCTGRATTTCCTGGAGAAAGGGG, TCCTGRATTTCCTGGAGAAAGGG, CTCCTGRATTTCCTGGAGAAAGG | Alport syndrome, X-linked recessive |
| 104886110 | COL4A5 | NM_000495.4(COL4A5):c.1268G>A (p.Gly423Glu) | CTGRACTTGACGGACAGCCTGGG, CCTGRACTTGACGGACAGCCTGG | Alport syndrome, X-linked recessive |
| 104886111 | COL4A5 | NM_000495.4(COL4A5):c.1276G>A (p.Gly426Arg) | GACRGACAGCCTGGGGCTCCTGG | Alport syndrome, X-linked recessive |
| 104886112 | COL4A5 | NM_000495.4(COL4A5):c.1286G>A (p.Gly429Glu) | CTGRGGCTCCTGGGCTTCCAGGG, CCTGRGGCTCCTGGGCTTCCAGG | Alport syndrome, X-linked recessive |
| 104886114 | COL4A5 | NM_000495.4(COL4A5):c.1397G>A (p.Gly466Glu) | AAAGRACTCCAAGGAGAACAAGG | Alport syndrome, X-linked recessive |
| 104886115 | COL4A5 | NM_000495.4(COL4A5):c.1406G>A (p.Gly469Glu) | CAAGRAGAACAAGGAGTGAAAGG | Alport syndrome, X-linked recessive |
| 104886117 | COL4A5 | NM_000495.4(COL4A5):c.1472G>A (p.Gly491Glu) | TCAGRGCCTCCAGGTCAACCTGG | Alport syndrome, X-linked recessive |
| 104886118 | COL4A5 | NM_000495.4(COL4A5):c.1481G>A (p.Gly494Asp) | CCAGRTCAACCTGGTTTGCCAGG | Alport syndrome, X-linked recessive |
| 104886122 | COL4A5 | NM_000495.4(COL4A5):c.1562G>A (p.Gly521Asp) | GCTGRTGCAACTGGTCCCAAAGG | Alport syndrome, X-linked recessive |
| 104886125 | COL4A5 | NM_000495.4(COL4A5):c.1607G>A (p.Gly536Asp) | CCAGRTGCTCCAGGCTTTCCTGG | Alport syndrome, X-linked recessive |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104886130 | COL4A5 | NM_000495.4(COL4A5): c.1736G>A (p.Gly579Glu) | CTGRACAGGATGGATTGCCAGGG, CCTGRACAGGATGGATTGCCAGG | Alport syndrome, X-linked recessive |
| 104886131 | COL4A5 | NM_000495.4(COL4A5): c.1780G>A (p.Gly594Ser) | TAGRGTGGAATTACTTTTAAGGG, TTAGRGTGGAATTACTTTTAAGG | Alport syndrome, X-linked recessive |
| 104886132 | COL4A5 | NM_000495.4(COL4A5): c.1783G>A (p.Gly595Arg) | TAGGGTRGAATTACTTTTAAGGG, TTAGGGTRGAATTACTTTTAAGG | Alport syndrome, X-linked recessive |
| 104886136 | COL4A5 | NM_000495.4(COL4A5): c.1681G>A (p.Gly561Arg) | AAARGAGAGTTGGGTTCCCCTGG | Alport syndrome, X-linked recessive |
| 104886138 | COL4A5 | NM_000495.4(COL4A5): c.1718G>A (p.Gly573Asp) | CCTGRTTTACCTGGCACTCCTGG | Alport syndrome, X-linked recessive |
| 104886139 | COL4A5 | NM_000495.4(COL4A5): c.1735G>A (p.Gly579Arg) | CCTRGACAGGATGGATTGCCAGG | Alport syndrome, X-linked recessive |
| 104886142 | COL4A5 | NM_000495.4(COL4A5): c.1871G>A (p.Gly624Asp) | CCCCCTGRTTTCGGCCCTCCAGG | Alport syndrome, X-linked recessive |
| 104886144 | COL4A5 | NM_000495.4(COL4A5): c.1886G>A (p.Gly629Asp) | CCAGRCCCAGTAGGTGAAAAAGG | Alport syndrome, X-linked recessive |
| 104886145 | COL4A5 | NM_000495.4(COL4A5): c.1895G>A (p.Gly632Asp) | GTAGRTGAAAAAGGCATACAAGG | Alport syndrome, X-linked recessive |
| 104886146 | COL4A5 | NM_000495.4(COL4A5): c.1897G>A (p.Glu633Lys) | GTAGGTRAAAAAGGCATACAAGG | Alport syndrome, X-linked recessive |
| 104886147 | COL4A5 | NM_000495.4(COL4A5): c.1912G>A (p.Gly638Ser) | CAARGTGTGGCAGGAAATCCAGG | Alport syndrome, X-linked recessive |
| 104886157 | COL4A5 | NM_000495.4(COL4A5): c.2023G>A (p.Gly675Ser) | GATRGTGATGTAGGTCTTCCAGG | Alport syndrome, X-linked recessive |
| 104886158 | COL4A5 | NM_000495.4(COL4A5): c.2042G>A (p.Gly681Asp) | TAGRTGACCCTGGACTTCCAGGG, ATAGRTGACCCTGGACTTCCAGG | Alport syndrome, X-linked recessive |
| 104886163 | COL4A5 | NM_000495.4(COL4A5): c.2165G>A (p.Gly722Glu) | CAGRACCTCCAGGAGCACCTGGG, CCAGRACCTCCAGGAGCACCTGG | Alport syndrome, X-linked recessive |
| 104886165 | COL4A5 | NM_000495.4(COL4A5): c.2219G>A (p.Gly740Glu) | CCTGRGCCACCCGGCTTTCCAGG | Alport syndrome, X-linked recessive |
| 104886166 | COL4A5 | NM_000495.4(COL4A5): c.2228G>A (p.Gly743Asp) | ACCCGRCTTTCCAGGACCAAAGG | Alport syndrome, X-linked recessive |
| 104886168 | COL4A5 | NM_000495.4(COL4A5): c.2060G>A (p.Gly687Glu) | CAGRGCAACCAGGCTTGCCAGGG, CCAGRGCAACCAGGCTTGCCAGG | Alport syndrome, X-linked recessive |
| 104886171 | COL4A5 | NM_000495.4(COL4A5): c.2287G>A (p.Gly763Arg) | CCARGACTTCCAGGTTTCAAAGG | Alport syndrome, X-linked recessive |
| 104886172 | COL4A5 | NM_000495.4(COL4A5): c.2297G>A (p.Gly766Asp) | CCAGRTTTCAAAGGAGCACTTGG | Alport syndrome, X-linked recessive |
| 104886174 | COL4A5 | NM_000495.4(COL4A5): c.2332G>A (p.Gly778Ser) | CGTRGTTTCCCAGGACCTCCGGG, TCGTRGTTTCCCAGGACCTCCGG | Alport syndrome, X-linked recessive |
| 104886177 | COL4A5 | NM_000495.4(COL4A5): c.2386G>A (p.Gly796Arg) | CCCTRGACCAAAAGGTATGGAGG, GCTCCCTRGACCAAAAGGTATGG | Alport syndrome, X-linked recessive |
| 104886179 | COL4A5 | NM_000495.4(COL4A5): c.2404G>A (p.Gly802Arg) | GTTRGACCAAATGGACAACCTGG | Alport syndrome, X-linked recessive |
| 104886180 | COL4A5 | NM_000495.4(COL4A5): c.2423G>A (p.Gly808Glu) | CTGRACCAATGGGACCTCCTGGG, CCTGRACCAATGGGACCTCCTGG | Alport syndrome, X-linked recessive |
| 104886182 | COL4A5 | NM_000495.4(COL4A5): c.2431G>A (p.Gly811Arg) | ATGRGACCTCCTGGGCTGCCAGG | Alport syndrome, X-linked recessive |
| 104886186 | COL4A5 | NM_000495.4(COL4A5): c.2554G>A (p.Gly852Arg) | CCTCCTRGACTTGATGTTCCAGG | Alport syndrome, X-linked recessive |
| 104886187 | COL4A5 | NM_000495.4(COL4A5): c.2555G>A (p.Gly852Glu) | CCTCCTGRACTTGATGTTCCAGG | Alport syndrome, X-linked recessive |
| 104886188 | COL4A5 | NM_000495.4(COL4A5): c.2597G>A (p.Gly866Glu) | CCAGRGATCCCCGGAGCACCTGG | Alport syndrome, X-linked recessive |
| 104886189 | COL4A5 | NM_000495.4(COL4A5): c.2605G>A (p.Gly869Arg) | CCCRGAGCACCTGGTCCTATAGG | Alport syndrome, X-linked recessive |
| 104886191 | COL4A5 | NM_000495.4(COL4A5): c.2624G>A (p.Gly875Glu) | TAGRACCTCCAGGATCACCAGGG, ATAGRACCTCCAGGATCACCAGG | Alport syndrome, X-linked recessive |
| 104886195 | COL4A5 | NM_000495.4(COL4A5): c.2804G>A (p.Gly935Asp) | CCTGRCCCTACAGGAGAAAAAGG | Alport syndrome, X-linked recessive |
| 104886210 | COL4A5 | NM_000495.4(COL4A5): c.3088G>A (p.Gly1030Ser) | ATCRGTGATATGGGTTTTCCAGG | Alport syndrome, X-linked recessive |
| 104886214 | COL4A5 | NM_000495.4(COL4A5): c.3115G>A (p.Gly1039Ser) | CAGRGTGTGGAAGGGCCTCCTGG | Alport syndrome, X-linked recessive |
| 104886215 | COL4A5 | NM_000495.4(COL4A5): c.3134G>A (p.Gly1045Glu) | CCTGRACCTTCTGGAGTTCCTGG | Alport syndrome, X-linked recessive |
| 104886223 | COL4A5 | NM_000495.4(COL4A5): c.3247G>A (p.Gly1083Ser) | CAGRGTGAGCCTGGTCTGCCTGG | Alport syndrome, X-linked recessive |
| 104886225 | COL4A5 | NM_000495.4(COL4A5): c.3319G>A (p.Gly1107Arg) | CCCRGATTACCAGGAACCCCTGG | Alport syndrome, X-linked recessive |
| 104886228 | COL4A5 | NM_000495.4(COL4A5): c.3427G>A (p.Gly1143Ser) | CCCRGCCTTCCAGGAGAACCTGG | Alport syndrome, X-linked recessive |
| 104886229 | COL4A5 | NM_000495.4(COL4A5): c.3428G>A (p.Gly1143Asp) | CCCGRCCTTCCAGGAGAACCTGG | Alport syndrome, X-linked recessive |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104886232 | COL4A5 | NM_000495.4(COL4A5): c.3257G>A (p.Gly1086Asp) | CTGRTCTGCCTGGATACCCAGGG, CCTGRTCTGCCTGGATACCCAGG | Alport syndrome, X-linked recessive |
| 104886235 | COL4A5 | NM_000495.4(COL4A5): c.3481G>A (p.Gly1161Arg) | CCARGGCCTCCAGGCGAAAAAGG | Alport syndrome, X-linked recessive |
| 104886236 | COL4A5 | NM_000495.4(COL4A5): c.3499G>A (p.Gly1167Ser) | AAARGCAAACCCGGTCAAGATGG | Alport syndrome, X-linked recessive |
| 104886237 | COL4A5 | NM_000495.4(COL4A5): c.3508G>A (p.Gly1170Ser) | CCCRGTCAAGATGGTATTCCTGG | Alport syndrome, X-linked recessive |
| 104886240 | COL4A5 | NM_000495.4(COL4A5): c.3535G>A (p.Gly1179Arg) | GCTRGACAGAAGGGTGAACCAGG | Alport syndrome, X-linked recessive |
| 104886244 | COL4A5 | NM_000495.4(COL4A5): c.3586G>A (p.Gly1196Arg) | CCTRGACTTCCAGGACTTTCTGG | Alport syndrome, X-linked recessive |
| 104886247 | COL4A5 | NM_000495.4(COL4A5): c.3632G>A (p.Gly1211Glu) | CCTGRGATTCCAGGAAATCCTGG | Alport syndrome, X-linked recessive |
| 104886248 | COL4A5 | NM_000495.4(COL4A5): c.3641G>A (p.Gly1214Glu) | CCAGRAAATCCTGGCCTTCCAGG | Alport syndrome, X-linked recessive |
| 104886250 | COL4A5 | NM_000495.4(COL4A5): c.3694G>A (p.Gly1232Ser) | CCTRGTGTGCAGGGTCCCCCAGG | Alport syndrome, X-linked recessive |
| 104886251 | COL4A5 | NM_000495.4(COL4A5): c.3659G>A (p.Gly1220Asp) | CCAGRTCCAAAGGGCGAACCAGG | Alport syndrome, X-linked recessive |
| 104886253 | COL4A5 | NM_000495.4(COL4A5): c.3686G>A (p.Gly1229Asp) | CACGRTTTCCCTGGTGTGCAGGG, TCACGRTTTCCCTGGTGTGCAGG | Alport syndrome, X-linked recessive |
| 104886257 | COL4A5 | NM_000495.4(COL4A5): c.3808G>A (p.Gly1270Ser) | GAARGTCCTCCAGGTCTCCCTGG | Alport syndrome, X-linked recessive |
| 104886261 | COL4A5 | NM_000495.4(COL4A5): c.3731G>A (p.Gly1244Asp) | TCTCCGGRTCCAGCTCTGGAAGG | Alport syndrome, X-linked recessive |
| 104886262 | COL4A5 | NM_000495.4(COL4A5): c.3754G>A (p.Gly1252Ser) | AAARGCAACCCTGGGCCCCAAGG | Alport syndrome, X-linked recessive |
| 104886263 | COL4A5 | NM_000495.4(COL4A5): c.3763G>A (p.Gly1255Arg) | CCTRGGCCCCAAGGTCCTCCTGG | Alport syndrome, X-linked recessive |
| 104886279 | COL4A5 | NM_000495.4(COL4A5): c.4342G>A (p.Gly1448Ser) | CAARGTCCCCCAGGTCCCCCTGG | Alport syndrome, X-linked recessive |
| 104886297 | COL4A5 | NM_000495.4(COL4A5): c.4787G>A (p.Gly1596Asp) | GATTGRTTATTCCTTCATGATGG | Alport syndrome, X-linked recessive |
| 104886331 | COL4A5 | NM_000495.4(COL4A5): c.1516+1G>A | TCCAGRTAAATTATGCCTCAGGG, CTCCAGRTAAATTATGCCTCAGG | Alport syndrome, X-linked recessive |
| 104886338 | COL4A5 | NM_000495.4(COL4A5): c.1780-1G>A | TTARGGTGGAATTACTTTTAAGG | Alport syndrome, X-linked recessive |
| 104886361 | COL4A5 | NM_000495.4(COL4A5): c.2705G>A (p.Gly902Glu) | ATGGRACCTCCAGGCCCACCAGG | Alport syndrome, X-linked recessive |
| 104886363 | COL4A5 | NM_000495.4(COL4A5): c.2732G>A (p.Gly911Glu) | TTGGRAATTCCTGGCAGGAGTGG | Alport syndrome, X-linked recessive |
| 104886370 | COL4A5 | NM_000495.4(COL4A5): c.2840G>A (p.Gly947Asp) | CCTGRCCTTCCAGGCCCTCCTGG | Alport syndrome, X-linked recessive |
| 104886378 | COL4A5 | NM_000495.4(COL4A5): c.3017-1G>A | CTARGTCCAAAGGTAACCCTGG | Alport syndrome, X-linked recessive |
| 104886384 | COL4A5 | NM_000495.4(COL4A5): c.3605-1G>A | ATARGCCAAAAGGGTGATGGAGG, TTCATARGCCAAAAGGGTGATGG | Alport syndrome, X-linked recessive |
| 104886396 | COL4A5 | NM_000495.4(COL4A5): c.385-719G>A | CAAGRTGGAGAGAAGGGTATTGG | Alport syndrome, X-linked recessive |
| 794727397 | COL4A5 | NM_000495.4(COL4A5): c.1844G>A (p.Gly615Glu) | CCAGRGAATATAGGGCCTATGGG, CCCAGRGAATATAGGGCCTATGG | Alport syndrome, X-linked recessive |
| 281874676 | COL4A5 | NM_000495.4(COL4A5): c.1738C>T (p.Gln580Ter) | CCTGGCACTCCTGGAYAGGATGG | Alport syndrome, X-linked recessive |
| 281874681 | COL4A5 | NM_000495.4(COL4A5): c.1856C>T (p.Pro619Leu) | CCCAGGGAATATAGGGCYTATGG, CCAGGGAATATAGGGCYTATGGG | Alport syndrome, X-linked recessive |
| 281874727 | COL4A5 | NM_000495.4(COL4A5): c.4147C>T (p.Gln1383Ter) | CCTCCAGGAATCCCTGGCYAGCC, CCAGGAATCCCTGGCYAGCCTGG | Alport syndrome, X-linked recessive |
| 281874661 | COL4A5 | NM_000495.4(COL4A5): c.1219C>T (p.Gln407Ter) | CCTGGAGAAAGGGGTYAGAAAGG | Alport syndrome, X-linked recessive |
| 104886094 | COL4A5 | NM_000495.4(COL4A5): c.1117C>T (p.Arg373Ter) | CCTGGAGAAAAGGAGAGYGAGG | Alport syndrome, X-linked recessive |
| 104886207 | COL4A5 | NM_000495.4(COL4A5): c.3046C>T (p.Gln1016Ter) | CCCTGGTCTCCCTGGAYAGCCAG, CCTGGTCTCCCTGGAYAGCCAGG | Alport syndrome, X-linked recessive |
| 104886213 | COL4A5 | NM_000495.4(COL4A5): c.3181C>T (p.Gln1061Ter) | CCCCAGGATTACCTGGAYAGAAA, CCCAGGATTACCTGGAYAGAAAG, CCAGGATTACCTGGAYAGAAAGG | Alport syndrome, X-linked recessive |
| 104886241 | COL4A5 | NM_000495.4(COL4A5): c.3538C>T (p.Gln1180Ter) | CCTGGACCAGCTGGAYAGAAGGG | Alport syndrome, X-linked recessive |
| 104886270 | COL4A5 | NM_000495.4(COL4A5): c.4228C>T (p.Arg1410Cys) | CCCTCCAGGAGATCCTGGAYGCA, CCTCCAGGAGATCCTGGAYGCAA, CCAGGAGATCCTGGAYGCAATGG | Alport syndrome, X-linked recessive |
| 104886286 | COL4A5 | NM_000495.4(COL4A5): c.4687C>T (p.Arg1563Ter) | CCAGCCATTCATTAGTYGGTAAG | Alport syndrome, X-linked recessive |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 61735045 | COL5A1 | NM_000093.4(COL5A1): c.1588G>A (p.Gly530Ser) | GGCRGCGATGCGGGCTCCAAAGG | Ehlers-Danlos syndrome, classic type, not specified |
| 121912935 | COL6A1 | NM_001848.2(COL6A1): c.1022G>A (p.Gly341Asp) | CCAGRCCTGCCAGGCTGCAAGGG, CCCAGRCCTGCCAGGCTGCAAGG | Bethlem myopathy |
| 794727788 | COL6A2 | NM_001849.3(COL6A2): c.812G>A (p.Gly271Asp) | AAGGRCAACATGGGTGAGCCGGG, CAAGGRCAACATGGGTGAGCCGG | Ullrich congenital muscular dystrophy, Bethlem myopathy |
| 121912940 | COL6A2 | NM_001849.3(COL6A2): c.811G>A (p.Gly271Ser) | AAGRGCAACATGGGTGAGCCGGG, CAAGRGCAACATGGGTGAGCCGG | Bethlem myopathy |
| 727502827 | COL6A2 | NM_001849.3(COL6A2): c.857G>A (p.Gly286Glu) | CAGGRAGACCCGGGCATCGAAGG | Congenital muscular dystrophy |
| 727502828 | COL6A2 | NM_001849.3(COL6A2): c.874G>A (p.Gly292Ser) | GAARGCCCCATTGGATTCCCAGG | Congenital muscular dystrophy |
| 267606750 | COL6A2 | NM_001849.3(COL6A2): c.1861G>A (p.Asp621Asn) | ATCRACAGCTCCGAGAGCATTGG | Congenital muscular dystrophy, Bethlem myopathy |
| 398123646 | COL6A2 | NM_001849.3(COL6A2): c.1522-1G>A | TCCTCCARGGAGACCCCGGCAGG | Ullrich congenital muscular dystrophy, Bethlem myopathy, not provided |
| 376880198 | COL6A2 | NM_001849.3(COL6A2): c.2527C>T (p.Arg843Trp) | CCTGCTGGACGGCTCCGAGYGGC | |
| 121912942 | COL6A2 | NM_001849.3(COL6A2): c.2455C>T (p.Gln819Ter) | CCCAGACCTTCCCTGCYAAACAG, CCAGACCTTCCCTGCYAAACAGG | Myosclerosis, autosomal recessive |
| 117725825 | COL6A2 | NM_001849.3(COL6A2): c.2795C>T (p.Pro932Leu) | CCATCGTGCGCAGCCYGCGTGGC | Congenital muscular dystrophy, Bethlem myopathy, not provided |
| 794727188 | COL6A3 | NM_004369.3(COL6A3): c.6239G>A (p.Gly2080Asp) | AACGRCACTCAAGGTTTCCAGGG, GAACGRCACTCAAGGTTTCCAGG | Bethlem myopathy |
| 398124128 | COL6A3 | NM_004369.3(COL6A3): c.6282+1G>A | AAGRTGAGGCGTGGGTGATGGGG, AAAGRTGAGGCGTGGGTGATGGG, TAAAGRTGAGGCGTGGGTGATGG | not provided |
| 121434554 | COL6A3 | NM_004369.3(COL6A3): c.1393C>T (p.Arg465Ter) | CCAACTTCAATGCCATCYGAGAC | Ullrich congenital muscular dystrophy |
| 121912829 | COL7A1 | NM_000094.3(COL7A1): c.6118G>A (p.Gly2040Ser) | CCTRGTATTCCCGGGCTCCCAGG | Generalized dominant dystrophic epidermolysis bullosa |
| 121912832 | COL7A1 | NM_000094.3(COL7A1): c.6007G>A (p.Gly2003Arg) | CGCRGGCTGAAGGGCGACCGTGG | Dominant dystrophic epidermolysis bullosa with absence of skin |
| 121912836 | COL7A1 | NM_000094.3(COL7A1): c.6127G>A (p.Gly2043Arg) | CCCRGGCTCCCAGGCAGGGCTGG, TATTCCCRGGCTCCCAGGCAGGG, GTATTCCCRGGCTCCCAGGCAGG | Generalized dominant dystrophic epidermolysis bullosa |
| 121912837 | COL7A1 | NM_000094.3(COL7A1): c.6724G>A (p.Gly2242Arg) | CAGRGGTCTCCAGGTTTGCCTGG | |
| 121912838 | COL7A1 | NM_000094.3(COL7A1): c.6091G>A (p.Gly2031Ser) | TCCRGCCTTGCCGGGGAGCCTGG | Recessive dystrophic epidermolysis bullosa |
| 121912839 | COL7A1 | NM_000094.3(COL7A1): c.6859G>A (p.Gly2287Arg) | GTCRGACCTAAAGGAGAACCTGG | Recessive dystrophic epidermolysis bullosa, Nail disorder, nonsyndromic congenital, 8 |
| 121912842 | COL7A1 | NM_000094.3(COL7A1): c.6017G>A (p.Gly2006Asp) | AAGGRCGACCGTGGAGACCCTGG | Generalized dominant dystrophic epidermolysis bullosa |
| 121912843 | COL7A1 | NM_000094.3(COL7A1): c.6044G>A (p.Gly2015Glu) | CCCTCAGGRGCCACCTGGTCTGG | Generalized dominant dystrophic epidermolysis bullosa |
| 121912844 | COL7A1 | NM_000094.3(COL7A1): c.6100G>A (p.Gly2034Arg) | GCCRGGGAGCCTGGAAAGCCTGG | Generalized dominant dystrophic epidermolysis bullosa |
| 121912846 | COL7A1 | NM_000094.3(COL7A1): c.6110G>A (p.Gly2037Glu) | CTGRAAGCCTGGTATTCCCGGG, CCTGRAAGCCTGGTATTCCCGG | Generalized dominant dystrophic epidermolysis bullosa |
| 121912850 | COL7A1 | NM_000094.3(COL7A1): c.6227G>A (p.Gly2076Asp) | GATGRCCCTCCTGGACTCCCTGG | Generalized dominant dystrophic epidermolysis bullosa |
| 121912851 | COL7A1 | NM_000094.3(COL7A1): c.7957G>A (p.Gly2653Arg) | CCCRGGCTGGCAGGACACAAAGG | Recessive dystrophic epidermolysis bullosa |
| 387906605 | COL7A1 | NM_000094.3(COL7A1): c.4565G>A (p.Gly1522Glu) | CAGGRGCCACCAGGACCCACTGG | Transient bullous dermolysis of the newborn |
| 121912847 | COL7A1 | NM_000094.3(COL7A1): c.4888C>T (p.Arg1630Ter) | CCCAGGACCTGTTGGCCCCYGAG, CCAGGACCTGTTGGCCCCYGAGG | Stickler syndrome, type 4 |
| 121912931 | COL9A1 | NM_001851.4(COL9A1): c.883C>T (p.Arg295Ter) | CCTACCCCTCCAGGGTGACYGAG, CCCTCCAGGGTGACYGAGGTCC, CCCTCCAGGGTGACYGAGGTCCT | |
| 387907076 | COLEC11 | NM_024027.4(COLEC11): c.610G>A (p.Gly204Ser) | CTTCATCRGCATCAACGACCTGG | Carnevale syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 312262904 | COMP | NM_000095.2(COMP): c.2155G>A (p.Gly719Ser) | CATGCGGRGTGGCCGCCTGGGGG, CCATGCGGRGTGGCCGCCTGGGGG | Pseudoachondroplastic spondyloepiphyseal dysplasia syndrome |
| 137852655 | COMP | NM_000095.2(COMP): c.2156G>A (p.Gly719Asp) | CATGCGGGRTGGCCGCCTGGGGG | Pseudoachondroplastic spondyloepiphyseal dysplasia syndrome |
| 121918231 | COQ2 | NM_015697.7(COQ2): c.590G>A (p.Arg197His) | GCCAATCRTCCAATAGCCGCTGG | Coenzyme Q10 deficiency, primary 1 |
| 143441644 | COQ4 | NM_016035.4(COQ4): c.718C>T (p.Arg240Cys) | CCTGTACTATGAGCGGYGCTGGG | COENZYME Q10 DEFICIENCY, PRIMARY, 7 |
| 397514755 | CORO1A | NM_001193333.2(COR01A): c.400G>A (p.Val134Met) | AGCGTRTGGGCATTGTGGCCTGG | Immunodeficiency 8 |
| 28939711 | COX15 | NM_004376.5(COX15): c.649C>T (p.Arg217Trp) | CCCATGACATCCCTYGGGTCAGT | Congenital myasthenic syndrome, acetazolamide-responsive, Cardioencephalomyopathy, fatal infantile, due to cytochrome c oxidase deficiency 2 |
| 61733458 | CP | NM_000096.3(CP): c.1652C>T (p.Thr551Ile) | CCARTGAATATATCTTTAGTGGG, CCCARTGAATATATCTTTAGTGG | Deficiency of ferroxidase, not specified |
| 386134156 | CP | NM_000096.3(CP): c.2701C>T (p.Arg901Ter) | CCCCCTGATTGTTTGTYGAAGAC, CCCCTGATTGTTTGTYGAAGACC, CCCTGATTGTTTGTYGAAGACCT | Deficiency of ferroxidase |
| 114402678 | CPA6 | NM_020361.4(CPA6): c.809C>T (p.Ala270Val) | TTCTATTGRCATCCACTCCACGG | Febrile seizures, familial, 11, not provided |
| 121917866 | CPDX | NM_000097.5(CPOX): c.991C>T (p.Arg331Trp) | CCCATCGTGGAGAAYGGCGGGGC | Coproporphyria |
| 121917871 | CPDX | NM_000097.5(CPOX): c.85C>T (p.Gln29Ter) | CCCCGCGCCTGGTCCYAGTGCGG, CCCGCGCCTGGTCCYAGTGCGGC | Coproporphyria |
| 28936374 | CPT | NM_001876.3(CPT1A): c.2126G>A (p.Gly709Glu) | CAGCGRAGGGGGCTTTGGACCGG | Carnitine palmitoyltransferase I deficiency |
| 80356780 | CPT | NM_001876.3(CPT1A): c.2129G>A (p.Gly710Glu) | CAGCGGAGRGGGCTTTGGACCGG | Carnitine palmitoyltransferase I deficiency |
| 80356794 | CPT1A | NM_001876.3(CPT1A): c.1425G>A (p.Trp475Ter) | CTGRGCAGATGCGCCGATCGTGG | Carnitine palmitoyltransferase I deficiency |
| 80356775 | CPT1A | NM_001876.3(CPT1A): c.367C>T (p.Arg123Cys) | CCCTCATCGTCACCATGYGCTAC, CCTCATCGTCACCATGYGCTACT | Carnitine palmitoyltransferase I deficiency, not provided |
| 80356779 | CPT1A | NM_001876.3(CPT1A): c.1436C>T (p.Pro479Leu) | CCTGGGCAGATGCGCYGATCGTG | Carnitine palmitoyltransferase I deficiency |
| 727503887 | CPT2 | NM_000098.2(CPT2): c.886C>T (p.Arg296Ter) | CCTGACCAGTGAGAACYGAGACA | CARNITINE PALMITOYLTRANSFERASE II DEFICIENCY, LATE-ONSET, Carnitine palmitoyltransferase II deficiency, infantile |
| 74315296 | CPT2 | NM_000098.2(CPT2): c.1507C>T (p.Arg503Cys) | CCGCACTGAGACCATCYGCCCGG | |
| 28939720 | CRB1 | NM_201253.2(CRB1): c.2234C>T (p.Thr745Met) | CCATGTTTGTCCGAAYGCTTCAA | Retinitis pigmentosa 12, not provided |
| 730880377 | CRB2 | NM_173689.6(CRB2): c.1897C>T (p.Arg633Trp) | CCGTTGCGACTGTGCCYGGCCCC | Ventriculomegaly with cystic kidney disease |
| 587783476 | CREBBP | NM_004380.2(CREBBP): c.286C>T (p.Gln96Ter) | CCAGCAGCCCCGTGYAGCAGGGC | Rubinstein-Taybi syndrome |
| 587783475 | CREBBP | NM_004380.2(CREBBP): c.2791C>T (p.Gln931Ter) | CCAGGTGACCCCGCAGCCTYAAA | Rubinstein-Taybi syndrome |
| 587783479 | CREBBP | NM_004380.2(CREBBP): c.3310C>T (p.Gln1104Ter) | CCTAGAAGCACTGTATCGAYAGG | Rubinstein-Taybi syndrome |
| 587783490 | CREBBP | NM_004380.2(CREBBP): c.4078C>T (p.Arg1360Ter) | CCGGGGAGGTTTTTGTCYGAGTG | Rubinstein-Taybi syndrome |
| 587783509 | CREBBP | NM_004380.2(CREBBP): c.598C>T (p.Gln200Ter) | CCATAGCTTAATTAATYAGGCTT | Rubinstein-Taybi syndrome |
| 587783510 | CREBBP | NM_004380.2(CREBBP): c.6088C>T (p.Gln2030Ter) | CCCCTTCCCCAGCAGYAGCCCAT, CCCTTCCCCAGCAGYAGCCCATG | Rubinstein-Taybi syndrome |
| 137853932 | CRLF1 | NM_004750.4(CRLF1): c.397+1G>A | TTGGCCRTAAGTTGGCACCCAGG | Cold-induced sweating syndrome 1 |
| 137853926 | CRLF1 | NM_004750.4(CRLF1): c.538C>T (p.Gln180Ter) | CCCCGCAGGTGGTATGGCYAGGA, CCCGCAGGTGGTATGGCYAGGAC, CCGCAGGTGGTATGGCYAGGACA | Cold-induced sweating syndrome 1 |
| 137853930 | CRLF1 | NM_004750.4(CRLF1): c.413C>T (p.Pro138Leu) | CCAGTGCCCCAGAGAAACYCGT | Cold-induced sweating syndrome 1 |
| 72659357 | CRTAP | NM_006371.4(CRTAP): c.3G>A (p.MetIle) | GATRGAGCCGGGGCGCCGGGGG, CGATRGAGCCGGGGCGCCGGGGG, GCGATRGAGCCGGGGCGCCGGGG, CGCGATRGAGCCGGGGCGCCGGG, GCGCGATRGAGCCGGGGCGCCGG | Osteogenesis imperfecta type 7 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894672 | CRX | NM_000554.4(CRX): c.121C>T (p.Arg41Trp) | CCCCCAGGAAGCAGCGGYGGGAG, CCCCAGGAAGCAGCGGYGGGAGC, CCCAGGAAGCAGCGGYGGGAGCG, CCAGGAAGCAGCGGYGGGAGCGC | Cone-rod dystrophy 2, not provided |
| 104894673 | CRX | NM_000554.4(CRX): c.268C>T (p.Arg90Trp) | CCAGGTTTGGTTCAAGAACYGGA | Leber congenital amaurosis 7, not provided |
| 74315440 | CRYAA | NM_000394.3(CRYAA): c.27G>A (p.Trp9Ter) | CCTGRTTCAAGCGCACCCTGGGG, CCCTGRTTCAAGCGCACCCTGGG, CCCCTGRTTCAAGCGCACCCTGG | |
| 397515623 | CRYAA | NM_000394.3(CRYAA): c.160C>T (p.Arg54Cys) | CCGCCAGTCCCTCTTCYGCACCG | Cataract, autosomal dominant |
| 397515624 | CRYAA | NM_000394.3(CRYAA): c.34C>T (p.Arg12Cys) | CCAGCACCCCTGGTTCAAGYGCA | Cataract, autosomal dominant, multiple types, with microcornea |
| 74315439 | CRYAA | NM_000394.3(CRYAA): c.346C>T (p.Arg116Cys) | CCCGTGAGTTCCACYGCCGCTAC | Cataract, autosomal dominant |
| 74315441 | CRYAA | NM_000394.3(CRYAA): c.145C>T (p.Arg49Cys) | CCATCAGCCCCTACTACYGCCAG | Cataract, autosomal dominant |
| 387907338 | CRYAB | NM_001885.2(CRYAB): c.166C>T (p.Arg56Trp) | CCACCCTCCTTCCTGYGGGCACC | Posterior polar cataract type 2 |
| 397515555 | CSF1R | NM_005211.3(CSF1R): c.1958G>A (p.Cys653Tyr) | GCCTRTACCCATGGAGGTAAGGG, AGCCTRTACCCATGGAGGTAAGG | Hereditary diffuse leukoencephalopathy with spheroids |
| 690016564 | CSF1R | NM_005211.3(CSF1R): c.2350G>A (p.Val784Met) | CGTAACRTGCTGTTGACCAATGG | Hereditary diffuse leukoencephalopathy with spheroids |
| 281860268 | CSF1R | NM_005211.3(CSF1R): c.1766G>A (p.Gly589Glu) | CCCTCGRAGCTGGAGCCTTTGGG, ACCCTCGRAGCTGGAGCCTTTGG | Hereditary diffuse leukoencephalopathy with spheroids |
| 397515556 | CSF1R | NM_005211.3(CSF1R): c.2329C>T (p.Arg777Trp) | CCCTCAGTGCATCCACYGGGACG, CCTCAGTGCATCCACYGGGACGT | Hereditary diffuse leukoencephalopathy with spheroids |
| 690016562 | CSF1R | NM_005211.3:c.2467C>T | CCTGTGAAGTGGATGGYCCCAGA | Hereditary diffuse leukoencephalopathy with spheroids |
| 606231473 | CSF3R | NM_000760.3(CSF3R): c.922C>T (p.Arg308Cys) | CCTACACCCTGCAGATAYGCTGC | Severe congenital neutropenia |
| 796065343 | CSF3R | NM_156039.3(CSF3R): c.1853C>T (p.Thr618Ile) | CCTCACCCTGATGAYCTTGACCC | Early T cell progenitor acute lymphoblastic leukemia |
| 1064039 | CST3 | NM_000099.3(CST3): c.73G>A (p.Ala25Thr) | CCCGCGRCCGGCTCCAGTCCCGG | Age-related macular degeneration 11 |
| 545986367 | CSTB | NM_000100.3(CSTB): c.136C>T (p.Gln46Ter) | CACCTRGCTCTTGAATGACACGG | not provided |
| 387907080 | CTC1 | NM_025099.5(CTC1): c.775G>A (p.Val259Met) | CCACRTGTCCATCATCGTGCAGG | Cerebroretinal microangiopathy with calcifications and cysts |
| 121913413 | CTNNB1 | NM_001904.3(CTNNB1): c.122C>T (p.Thr41Ile) | CCATTCTGGTGCCACTAYCACAG | Pilomatrixoma |
| 35086888 | CTNS | NM_001031681.2(CTNS): c.124G>A (p.Val42Ile) | CCGCAGGGTGAGGCTGAYGTTGG | Cystinosis, atypical nephropathic |
| 515726209 | CTRC | NM_007272.2(CTRC): c.217G>A (p.Ala73Thr) | TCACTGCCRCCCACTGCATCAGG | Hereditary pancreatitis |
| 121909293 | CTRC | NM_007272.2(CTRC): c.760C>T (p.Arg254Trp) | CCGGTAGTCTACACCYGGGTGTC | Hereditary pancreatitis, Pancreatitis, chronic, susceptibility to |
| 104894209 | CTSC | NM_001814.4(CTSC): c.856C>T (p.Gln286Ter) | CCCCAATCCTAAGCCCYAGGAG, CCAATCCTAAGCCCYAGGAGG, CAATCCTAAGCCCYAGGAGGT | Papillon-Lenxc3\xa8vre syndrome |
| 587779409 | CTSD | NM_001909.4(CTSD): c.470C>T (p.Ser157Leu) | CCAGGACACTGTGTYGGTGAGTC | Ceroid lipofuscinosis neuronal 10 |
| 3732378 | CX3CR1 | NM_001171174.1(CX3CR1): c.935C>T (p.Thr312Met) | AACCRTCTCAGTCACACTGAGGG, CAACCRTCTCAGTCACACTGAGG | Age-related macular degeneration 12 |
| 3732379 | CX3CR1 | NM_001171174.1(CX3CR1): c.841G>A (p.Val281Ile) | CCAGGAAAATCATAAYGTTGTAG | Age-related macular degeneration 12 |
| 104893624 | CXCR4 | NM_003467.2(CXCR4): c.1000C>T (p.Arg334Ter) | CCTCTCCAAAGGAAAGYGAGGTG | Warts, hypogammaglobulinemia, infections, and myelokathexis |
| 121965009 | CYB5R3 | NM_000398.6(CYB5R3): c.316G>A (p.Val106Met) | CTTCRTGGACCTGGTCATCAAGG | METHEMOGLOBINEMIA, TYPE I |
| 61732609 | CYB5R3 | NM_000398.6(CYB5R3): c.478C>T (p.Arg160Ter) | GTCRGATGGCGAACTTCCCTGGG, GGTCRGATGGCGAACTTCCCTGG | Methemoglobinemia type 2 |
| 121965014 | CYB5R3 | NM_000398.6(CYB5R3): c.229C>T (p.Gln77Ter) | CCCGTTCTGTCCTGCAGGCYAGC, CCGTTCTGTCCTGCAGGCYAGCA | Methemoglobinemia type 2 |
| 200872504 | CYB5R3 | NM_000398.6(CYB5R3): c.463+8G>C | CCAAGGGATTCCGACCYGAATCA | Methemoglobinemia type 2 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137854590 | CYBB | NM_000397.3(CYBB): c.466G>A (p.Ala156Thr) | TTTTRCTCGAAAGAGAATAAAGG | Granulomatous disease, chronic, X-linked, variant, not provided |
| 104894139 | CYP17A1 | NM_000102.3(CYP17A1): c.1073G>A (p.Arg358Gln) | TCCRAGAGGTGCTTCGCCTCAGG | Isolated 17,20-lyase deficiency |
| 104894153 | CYP17A1 | NM_000102.3(CYP17A1): c.287G>A (p.Arg96Gln) | GGGCRGCCTCAAATGGTAAGTGG | Complete combined 17-alpha-hydroxylase/17,20-lyase deficiency |
| 104894154 | CYP17A1 | NM_000102.3(CYP17A1): c.374G>A (p.Arg125Gln) | GCTGCATCRAAGGCTGGCGATGG | Complete combined 17-alpha-hydroxylase/17,20-lyase deficiency |
| 104894155 | CYP17A1 | NM_000102.3(CYP17A1): c.1247G>A (p.Arg416His) | AGCRTTTCTTGAATCCAGCGGGG, GAGCRTTTCTTGAATCCAGCGGG, AGAGCRTTTCTTGAATCCAGCGG | Complete combined 17-alpha-hydroxylase/17,20-lyase deficiency |
| 104894142 | CYP17A1 | cM_000102.3(CYP17A1): c.1084C>T (p.Arg362Cys) | CCATCCGAGAGGTGCTTYGCCTC | Complete combined 17-alpha-hydroxylase/17,20-lyase deficiency |
| 104894145 | CYP17A1 | NM_000102.3(CYP17A1): c.1283C>T (p.Pro428Leu) | CCCAGCTCATCTCACYGTCAGTA, CCAGCTCATCTCACYGTCAGTAA | Complete combined 17-alpha-hydroxylase/17,20-lyase deficiency |
| 104894149 | CYP17A1 | NM_000102.3(CYP17A1): c.1039C>T (p.Arg347Cys) | CCAACTATCAGTGACYGTAACCG | Combined partial 17-alpha-hydroxylase/17,20-lyase deficiency |
| 28936700 | CYP1B1 | NM_000104.3(CYP1B1): c.182G>A (p.Gly61Glu) | ATCGRAAACGCGGCGGCGGTGGG, GATCGRAAACGCGGCGGCGGTGG, ACTGATCGRAAACGCGGCGGCGG | Glaucoma, congenital |
| 201824781 | CYP1B1 | NM_000104.3(CYP1B1): c.155C>T (p.Pro52Leu) | ACGGGCCCRGGGGCGCGGACCGG | Glaucoma, primary open angle, juvenile-onset |
| 79204362 | CYP1B1 | NM_000104.3(CYP1B1): c.1103G>A (p.Arg368His) | CCCATACAAGGCAGAYGGTCCCT, CCATACAAGGCAGAYGGTCCCTC | Glaucoma, congenital, Coloboma, not provided |
| 151344503 | CYP21A2 | NM_000500.7(CYP21A2): c.1217G>A (p.Trp406Ter) | GTTCTRGCCTGGTATGTGGGGGG, AGTTCTRGCCTGGTATGTGGGGG, GAGTTCTRGCCTGGTATGTGGGG, TGAGTTCTRGCCTGGTATGTGGG | 21-hydroxylase deficiency |
| 7769409 | CYP21A2 | NM_000500.7(CYP21A2): c.1069C>T (p.Arg357Trp) | CCGAGGTGCTGCGCCTGYGGCCC | 21-hydroxylase deficiency |
| 6445 | CYP21A2 | NM_000500.7(CYP21A2): c.1360C>T (p.Pro454Ser) | CCTTCACGCTGCTGYCCTCCGGG | 21-hydroxylase deficiency |
| 9378251 | CYP21A2 | NM_000500.7(CYP21A2): c.92C>T (p.Pro31Leu) | CCGGAGCCTCCACCTTCCYGCCTC | 21-hydroxylase deficiency |
| 7755898 | CYP21A2 | NM_000500.7(CYP21A2): c.955C>T (p.Gln319Ter) | CCAGATTCAGCAGCGACTGYAGG | 21-hydroxylase deficiency |
| 387907324 | CYP24A1 | NM_000782.4(CYP24A1): c.964G>A (p.Glu322Lys) | CACARAGCTCCAGCTGGCTGCGG | Idiopathic hypercalcemia of infancy |
| 121908097 | CYP27A1 | NM_000784.3(CYP27A1): c.1421G>A (p.Arg474Gln) | TCCRGGCCTGCCTGGGCCGCAGG | Cholestanol storage disease |
| 121908099 | CYP27A1 | NM_000784.3(CYP27A1): c.1214G>A (p.Arg405Gln) | AAACTCCCRGATCATAGAAAAGG | Cholestanol storage disease |
| 587778797 | CYP27A1 | NM_000784.3(CYP27A1): c.446+1G>A | CACRTGAGCTGGGGCCTGAAGGG, CCACRTGAGCTGGGGCCTGAAGG | Cholestanol storage disease |
| 376230356 | CYP27A1 | NM_000784.3(CYP27A1): c.380G>A (p.Arg127Gln) | TACRGAACGACATGGAGCTATGG | Cholestanol storage disease |
| 72551314 | CYP27A1 | NM_000784.3(CYP27A1): c.475C>T (p.Gln159Ter) | CCACTGGTACCAGCTGCGCYAGG | Cholestanol storage disease |
| 72551316 | CYP27A1 | NM_000784.3(CYP27A1): c.745C>T (p.Gln249Ter) | CCATCGGGTTAATGTTCYAGAAC | Cholestanol storage disease |
| 121908098 | CYP27A1 | NM_000784.3(CYP27A1): c.1420C>T (p.Arg474Trp) | CCCTTTGGCTATGGGTCYGGGC, CCTTTGGCTATGGGTCYGGGCC | Cholestanol storage disease |
| 587778787 | CYP27A1 | NM_000784.3(CYP27A1): c.1402C>T (p.Pro468Ser) | CCCATTTGGCTCTGTGYCCTTTG, CCATTTGGCTCTGTGYCCTTTGG | Cholestanol storage disease |
| 28934604 | CYP27B1 | NM_000785.3(CYP27B1): c.320G>A (p.Arg107His) | AGCRCTGCAGCTTCTCGCCCTGG | Vitamin D-dependent rickets, type 1 |
| 118204008 | CYP27B1 | NM_000785.3(CYP27B1): c.1226C>T (p.Thr409Ile) | CCAGACGCTGGTCAYTCTGTGTC | Vitamin D-dependent rickets, type 1 |
| 118204011 | CYP27B1 | NM_000785.3(CYP27B1): c.1027C>T (p.Leu343Phe) | CCCCGAAGTCCAGACAGCAYTCC, CCCGAAGTCCAGACAGCAYTCCA, CCGAAGTCCAGACAGCAYTCCAC | Vitamin D-dependent rickets, type 1 |
| 199476187 | CYP4V2 | NM_207352.3(CYP4V2): c.283G>A (p.Gly95Arg) | GGTCRGGCCAGTGCCCATGGTGG, CTGGGTCRGGCCAGTGCCCATGG | Bietti crystalline corneoretinal dystrophy |
| 199476198 | CYP4V2 | NM_207352.3(CYP4V2): c.1020G>A (p.Trp340Ter) | AACTGRTCCTTATACCTGTTGGG, AAACTGRTCCTTATACCTGTTGG | Bietti crystalline corneoretinal dystrophy |
| 119103284 | CYP4V2 | NM_207352.3(CYP4V2): c.1523G>A (p.Arg508His) | TTCRTCCAAGTAATGGCATCTGG | Bietti crystalline corneoretinal dystrophy |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199476202 | CYP4V2 | NM_207352.3(CYP4V2): c.1187C>T (p.Pro396Leu) | CCTTTTTCCTTCTGTTCYTTTAT | Bietti crystalline corneoretinal dystrophy |
| 121908611 | CYP7B1 | NM_004820.3(CYP7B1): c.1250G>A (p.Arg417His) | TATGATCRTTTTATAGAAGATGG | Spastic paraplegia 5A |
| 72554620 | CYP7B1 | NM_004820.3(CYP7B1): c.1162C>T (p.Arg388Ter) | CCGGGGACTACTGTGTGYGAAAG | Spastic paraplegia 5A, Bile acid synthesis defect, congenital, 3 |
| 193922955 | DAG1 | NM_001165928.3(DAG1): c.575C>T (p.Thr192Met) | CCTGTGACTGTTTTGAYGGTGAT | Limb-girdle muscular dystrophy-dystroglycanopathy, type C9, not provided |
| 121918212 | DARS2 | NM_018122.4(DARS2): c.1837C>T (p.Leu613Phe) | CCTTCCGGGACATGACYTCATG | Leukoencephalopathy with Brainstem and Spinal Cord Involvement and Lactate Elevation |
| 200670286 | DARS2 | NM_018122.4(DARS2): c.1825C>T (p.Arg609Trp) | CCTTCCCAAAGTCCTTCYGGGGA | Leukoencephalopathy with Brainstem and Spinal Cord Involvement and Lactate Elevation |
| 267606760 | DBH | NM_000787.3(DBH): c.301G>A (p.Val101Met) | CTCRTGGTGCTCTGGACCGATGG | Dopamine beta hydroxylase deficiency |
| 185492864 | DBT | NM_001918.3(DBT): c.901C>T (p.Arg301Cys) | ATTCCACRAGCAAATGCAATGGG, AATTCCACRAGCAAATGCAATGG | Maple syrup urine disease, not provided |
| 72466485 | DCTN1 | NM_004082.4(DCTN1): c.211G>A (p.Gly71Arg) | ATGATRGAACTGTTCAAGGCAGG | Perry syndrome |
| 104894779 | DCX | NM_178152.2(DCX): c.184G>A (p.Asp62Asn) | ATGGGRACCGCTACTTCAAGGGG, AATGGGRACCGCTACTTCAAGGG, CAATGGGRACCGCTACTTCAAGG | Lissencephaly, X-linked, Subcortical laminar heterotopia, X-linked |
| 587783544 | DCX | NM_178151.2(DCX): c.364G>A (p.Gly122Arg) | AGGAARGTAATTTAAATAGTGGG, GAGGAARGTAATTTAAATAGTGG | Heterotopia |
| 587783527 | DCX | NM_178151.2(DCX): c.182G>A (p.Gly61Glu) | ATGRGGACCGCTACTTCAAGGGG, AATGRGGACCGCTACTTCAAGGG, CAATGRGGACCGCTACTTCAAGG | Heterotopia |
| 587783589 | DCX | NM_178151.2(DCX): c.809-1G>A | CCARAATGCCGAGTCATGAAGGG, CCCARAATGCCGAGTCATGAAGG | Heterotopia |
| 104894780 | DCX | NM_178151.2(DCX): c.574C>T (p.Arg192Trp) | CCGCAGTGGGGTGAAGCCTYGGA | Lissencephaly, X-linked, Subcortical laminar heterotopia, X-linked, Heterotopia |
| 587783519 | DCX | NM_178151.2(DCX): c.115C>T (p.Arg39Ter) | CCCACTGTAGCTTCTACYGAACC, CCACTGTAGCTTCTACYGAACCA | Heterotopia |
| 587783522 | DCX | NM_178151.2(DCX): c.130C>T (p.Gln44Ter) | CCGAACCAGAACCTTGYAGGCAC | Heterotopia |
| 587783535 | DCX | NM_178151.2(DCX): c.232C>T (p.Arg78Cys) | CCTCTGACCGTTTTYGCAGCTTT | Heterotopia |
| 587783541 | DCX | NM_178151.2(DCX): c.304C>T (p.Arg102Cys) | CCTGCCTCAGGGAGTGYGTTACA | Heterotopia |
| 587783554 | DCX | NM_178151.2(DCX): c.478C>T (p.Gln160Ter) | CCAATATGAAAGCCCCCYAGTCC | Heterotopia |
| 587783590 | DCX | NM_178151.2(DCX): c.814C>T (p.Arg272Ter) | CCTTTTGCCCCAGAATGCYGAGT | Heterotopia |
| 587783592 | DCX | NM_178151.2(DCX): c.907C>T (p.Arg303Ter) | CCCTGGTCCTATGCGCYGAAGCA, CCTGGTCCTATGCGCYGAAGCAA | Heterotopia |
| 121434641 | DDB2 | NM_000107.2(DDB2): c.937C>T (p.Arg313Ter) | CCAGAAGAGCGAGATCYGAGTTT | Xeroderma pigmentosum, group E |
| 137853208 | DDC | NM_001082971.1(DDC): c.749C>T (p.Ser250Phe) | CCACAACATGCTGCTYCTTTGAC | Deficiency of aromatic-L-amino-acid decarboxylase |
| 121964863 | DDR2 | NM_001014796.1(DDR2): c.2254C>T (p.Arg752Cys) | CCGGGCAGTGCTCCCTATCYGCT | Spondylometaepiphyseal dysplasia short limb-hand type |
| 796052231 | DDX3X | NM_001356.4(DDX3X): c.1126C>T (p.Arg376Cys) | CCTCCAAAGGGTGTCYGCCACAC | not provided, MENTAL RETARDATION, X-LINKED 102 |
| 796052234 | DDX3X | NM_001356.4(DDX3X): c.1462C>T (p.Arg488Cys) | CCCTTCACCAGTTCYGCTCAGGA | not provided |
| 796052236 | DDX3X | NM_001356.4(DDX3X): c.1490C>T (p.Ala497Val) | CCCAATTTTAGTGGYTACAGCAG | not provided |
| 587777408 | DEAR | NM_021008.3(DEAF1): c.670C>T (p.Arg224Trp) | CCCCRGCCGCCTGCAAGGAAGGG, TCCCCRGCCGCCTGCAAGGAAGG | Mental retardation, autosomal dominant 24 |
| 587777458 | DEPDC5 | NM_001242896.1(DEPDC5): c.3259C>T (p.Arg1087Ter) | CCTACATGGACAGCCCAYGAAAG | Epilepsy, partial, with variable foci |
| 748323823 | DES | NM_001927.3(DES): c.1371+1G>A | GGGAGRTAAGTGGTCTGTCTGGG, GGGGAGRTAAGTGGTCTGTCTGG | not provided |
| 57694264 | DES | NM_001927.3(DES): c.1201G>A (p.Glu401Lys) | ATGTGRAGATTGCCACCTACCGG | not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 61726467 | DES | NM_001927.3(DES): c.1237G>A (p.Glu413Lys) | GGGAGAGRAGAGCCGGTGAGGGG, AGGGAGAGRAGAGCCGGTGAGGG | not provided |
| 62635763 | DES | NM_001927.3(DES): c.1255C>T (p.Pro419Ser) | CCCTTTTAGGATCAATCTCYCCA, CCTTTTAGGATCAATCTCYCCAT | Myofibrillar myopathy 1, not provided |
| 62636495 | DES | NM_001927.3(DES): c.38C>T (p.Ser13Phe) | CCAGCCAGCGCGTGTCCTYCTAC, CCAGCGCGTGTCCTYCTACCGCC | Dilated cardiomyopathy 11, Myofibrillar myopathy 1, not provided |
| 397517255 | DFNB31 | NM_015404.3(DFNB31): c.1267C>T (p.Arg423Ter) | CCTGGGGAACCAGACAYGAGTGC | Usher syndrome, type 2D |
| 779760634 | DFNB31 | NM_015404.3(DFNB31): c.1417-1G>A | CCTCAGAGAGGAGTGAGAAYTGG | Deafness, autosomal recessive 31 |
| 137852839 | DFNB31 | NM_015404.3(DFNB31): c.2332C>T (p.Arg778Ter) | CCAGCGCCCCAGGCYGAGGAAGG | Deafness, autosomal recessive 31 |
| 398123008 | DGKE | NM_003647.2(DGKE): c.127C>T (p.Gln43Ter) | CCTTCTGGTGTAGCCTYCAGCGG | Nephrotic syndrome, type 7 |
| 104893631 | DGUOK | NM_080916.2(DGUOK): c.425G>A (p.Arg142Lys) | AGARGTCTGTGTACAGTGACAGG | Mitochondrial DAN-depletion syndrome 3, hepatocerebral |
| 121909764 | DHCR7 | NM_001360.2(DHCR7): c.730G>A (p.Gly244Arg) | GGCGCCCCRGGATCGTCGCCTGG | Smith-Lemli-Opitz syndrome |
| 80338857 | DHCR7 | NM_001360.2(DHCR7): c.725G>A (p.Arg242His) | GGCRCCCCGGGATCGTCGCCTGG | Smith-Lemli-Opitz syndrome |
| 398123607 | DHCR7 | NM_001360.2(DHCR7): c.841G>A (p.Val281Met) | TCTACRTGATTGACTTCTTCTGG | Smith-Lemli-Opitz syndrome, not provided |
| 80338853 | DHCR7 | NM_001360.2(DHCR7): c.278C>T (p.Thr93Met) | CCAAGACTCCACCTATAAYGAGG | Smith-Lemli-Opitz syndrome, not provided |
| 104886035 | DHCR7 | NM_001360.2(DHCR7):1 c.151C>T (p.Pro51Ser) | CCTACTGCTGTTCGCCYCCTTCA | Smith-Lemli-Opitz syndrome, not provided |
| 267606766 | DHODH | NM_001361.4(DHODH): c.454G>A (p.Gly152Arg) | CAGTCACRGGCTTTCAGTGGTGG | Miller syndrome |
| 201230446 | DHODH | NM_001361.4(DHODH): c.403C>T (p.Arg135Cys) | CCCTAGACCCAGAGTCTTCYGCC, CCTAGACCCAGAGTCTTCYGCCT | Miller syndrome |
| 199422247 | DKC1 | NM_001363.4(DKC1): c.911G>A (p.Ser304Asn) | AAGACARTGCAGTAAGTTCCGGG, AAAGACARTGCAGTAAGTTCCGG | Dyskeratosis congenita X-linked |
| 121912289 | DKC1 | NM_001363.4(DKC1): c.1226C>T (p.Pro409Leu) | CCCACAGACAGCACACYTGCCAC, CCACAGACAGCACACYTGCCACC | Dyskeratosis congenita X-linked |
| 121964992 | DLD | NM_000108.4(DLD): c.1123G>A (p.Glu375Lys) | TGTGTTAAGGAATGGCTGGTGG | Maple syrup urine disease, type 3, not provided |
| 796065346 | DLL4 | NM_019074.3(DLL4): c.1169G>A (p.Cys390Tyr) | GAATRTCCCCCCAACTTCACCGG | Adams-Oliver syndrome, ADAMS-OLIVER SYNDROME 6 |
| 398122853 | DMD | NM_004006.2(DMD): c.9G>A (p.Trp3Ter) | GCTTTGRTGGGAAGAAGTAGAGG | Duchenne muscular dystrophy, Becker muscular dystrophy, Dilated cardiomyopathy 3B, not provided |
| 398123936 | DMD | NM_004006.2(DMD): c.336G>A (p.Trp112Ter) | TTTGRAATATAATCCTCCACTGG | Duchenne muscular dystrophy, Becker muscular dystrophy, Dilated cardiomyopathy 3B |
| 398123939 | DMD | NM_004006.2(DMD): c.3433-1G>A | GAARGTCTATGCCAGAAAGGAGG, GTGGAARGTCTATGCCAGAAAGG | Dilated cardiomyopathy 3B |
| 398124032 | DMD | NM_004006.2(DMD): c.649+1G>A | CCTGAAGRTTGGTAAATTTCTGG | Duchenne muscular dystrophy, Becker muscular dystrophy, Dilated cardiomyopathy 3B |
| 398124076 | DMD | NM_004006.2(DMD): c.8668G>A (p.Glu2890Lys) | AGCCCAGARGTAATTGAATGTGG | Dilated cardiomyopathy 3B |
| 398124096 | DMD | NM_004006.2(DMD): c.9564-1G>A | ATAATARGGGACGAACAGGGAGG | Duchenne muscular dystrophy, Becker muscular dystrophy, Dilated cardiomyopathy 3B |
| 794727499 | DMD | NM_004006.2(DMD): c.133C>T (p.Gln45Ter) | CCTCTTCAGTGACCTYAGGATG | Duchenne muscular dystrophy, Becker muscular dystrophy |
| 128626233 | DMD | NM_004006.2(DMD): c.178C>T (p.Gln60Ter) | CCTCGAAGGCCTGACAGGGYAAA | Duchenne muscular dystrophy |
| 128626238 | DMD | NM_000109.3(DMD): c.700C>T (p.Gln234Ter) | CCAAGTTTTGCCTCAAYAAGTGA | Duchenne muscular dystrophy |
| 128626245 | DMD | NM_004006.2(DMD): c.3121C>T (p.Gln1041Ter) | CCAGCTGGTTGAGCATTGTYAAA | Duchenne muscular dystrophy, Dilated cardiomyopathy 3B |
| 398123865 | DMD | NM_004006.2(DMD): c.1615C>T (p.Arg539Ter) | CCAGGTATTGGGAGATYGATGGG | Duchenne muscular dystrophy, Becker muscular dystrophy, Dilated cardiomyopathy 3B |
| 398123903 | DMD | NM_004006.2(DMD): c.2650C>T (p.Gln884Ter) | CCGGCTATCAGATCTTYAACCTC | Duchenne muscular dystrophy, Becker muscular dystrophy, Dilated cardiomyopathy 3B |
| 398123912 | DMD | NM_004006.2(DMD): c.2866C>T (p.Gln956Ter) | CCATCAGGACATGGGTCYAGCAG | Dilated cardiomyopathy 3B |
| 398123954 | DMD | NM_004006.2(DMD): c.4405C>T (p.Gln1469Ter) | CCAGCCAATTTTGAGYAGCGTCT | Dilated cardiomyopathy 3B |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 398123990 | DMD | NM_004006.2(DMD): c.5353C>T (p.Gln1785Ter) | CCTTTGAAGGAATTGGAGYAGTT | Dilated cardiomyopathy 3B |
| 398123999 | DMD | NM_004006.2(DMD): c.583C>T (p.Arg195Ter) | CCAGCAGTCAGCCACACAAYGAC | Duchenne muscular dystrophy, Becker muscular dystrophy, Dilated cardiomyopathy 3B |
| 398124058 | DMD | NM_004006.2(DMD): c.7894C>T (p.Gln2632Ter) | CCAAAGACCTCCGCYAGTGGCAG | Duchenne muscular dystrophy, Becker muscular dystrophy, Dilated cardiomyopathy 3B |
| 398124099 | DMD | NM_004006.2(DMD): c.961-5831C>T | CCTTTGTGACCTTTGGYAAGTCA | Dilated cardiomyopathy 3B |
| 368260932 | DNAH11 | (NM_001277115.1(DNAH11): c.8698C>T (p.Arg2900Ter) | CCAATTTGTACATCYGAACTGGA | Ciliary dyskinesia, primary, 7 |
| 567050969 | DNAH8 | NM_001206927.1(DNAH8): c.2419C>T (p.Arg807Ter) | CCACGCTTTTTGTGYGACATCCA | Kartagener syndrome, not provided |
| 730882139 | DNAJB2 | NM_001039550.1(DNAJB2): c.229+1G>A | GACAGRTAGGTGGAGTGGTGAGG | Charcot-Marie-Tooth disease, Spinal muscular atrophy, distal, autosomal recessive, 5 |
| 398122405 | DNAJC6 | NM_001256865.1(DNAJC6): c.2200C>T (p.Gln734Ter) | CCCCACTCCTCTCCCYAGAACCG, CCCACTCCTCTCCCYAGAACCGA | Parkinson disease 19, juvenile-onset |
| 121909089 | DNM2 | NM_001005360.2(DNM2): c.1106G>A (p.Arg369Gln) | CGAGCRGTTCCCATTTGAGCTGG | Myopathy, centronuclear, 1, Myopathy, centronuclear |
| 796065342 | DNMT3A | NM_175629.2(DNMT3A): c.1204C>T (p.Gln402Ter) | CCAAGGCCGTGGAGGTGYAGAAC | Early T cell progenitor acute lymphoblastic leukemia |
| 121908943 | DNMT3B | NM_006892.3(DNMT3B): c.1807G>A (p.Ala603Thr) | CGTCRCTTCTGAAGTGTGTGAGG | Centromeric instability of chromosomes 1,9 and 16 and immunodeficiency |
| 547940069 | DNMT3B | NM_175850.2(DNMT3B): c.2397-11G>A | TCCRGTACCCCCAGGATCTTTGG | Centromeric instability of chromosomes 1,9 and 16 and immunodeficiency |
| 780318765 | DOCK2 | NM_004946.2(DOCK2): c.3310C>T (p.Arg1104Trp) | CCCTGAGGCTGAGCTCYGGAAAG, CCTGAGGCTGAGCTCYGGAAAGC | IMMUNODEFICIENCY 40 |
| 587777484 | DOCK7 | NM_033407.3(DOCK7): c.3616C>T (p.Arg1206Ter) | CCACTCRAGCCTTTATCTGAGGG, GCCACTCRAGCCTTTATCTGAGG | Epileptic encephalopathy, early infantile, 23 |
| 397515322 | DPAGT1 | NM_001382.3(DPAGT1): c.161+5G>A | TGARCAGCGGCACACGGGTCCGG, AGATGTGARCAGCGGCACACGGG | Congenital disorder of glycosylation type 1J |
| 397515640 | DSG1 | NM_001942.3(DSG1): c.601C>T (p.Gln201Ter) | CCTTCAAGATTATAAGAYAAGAA | Keratosis palmoplantaris striata 1 |
| 751012696 | DSG2 | NM_001943.3(DSG2): c.889G>A (p.Asp297Asn) | GTGTTCRATGCAGATGAAATAGG | Cardiomyopathy |
| 121913008 | DSG2 | NM_001943.3(DSG2): c.137G>A (p.Arg46Gln) | TAGTGCRGCAAAAGCGCGCCTGG | Arrhythmogenic right ventricular cardiomyopathy, type 10, Cardiomyopathy |
| 121913013 | DSG2 | NM_001943.3(DSG2): c.166G>A (p.Val56Met) | GCCCCCRTGGCTCTTCGGGAGGG, CGCCCCRTGGCTCTTCGGGAGG | Arrhythmogenic right ventricular cardiomyopathy, Arrhythmogenic right ventricular cardiomyopathy, type 10, Catecholaminergic polymorphic ventricular tachycardia, Dilated cardiomyopathy 1BB, Primary familial hypertrophic cardiomyopathy, Cardiomyopathy, not specified |
| 201564919 | DSG2 | NM_001943.3(DSG2): c.1912G>A (p.Gly638Arg) | CATTGCRGAAAGGGCGCCAAAGG | Arrhythmogenic right ventricular cardiomyopathy, Cardiomyopathy, not specified |
| 794728083 | DSG2 | NM_001943.3(DSG2): c.769C>T (p.Gln257Ter) | CCTGTAAAACAAGCTYAAGTTCA | Cardiomyopathy |
| 121912998 | DSP | NM_004415.2(DSP): c.88G>A (p.Val30Met) | GAGRTGACCAGCGGCGGCGGGGG, CGAGRTGACCAGCGGCGGCGGGG, ACGAGRTGACCAGCGGCGGCGGG, TACGAGRTGACCAGCGGCGGCGG | Arrhythmogenic right ventricular cardiomyopathy, Arrhythmogenic right ventricular cardiomyopathy, type 8, not specified, not provided |
| 121912999 | DSP | NM_004415.2(DSP): c.8501G>A (p.Arg2834His) | CTCRCTCCGGATCTCGCTCCGGG, TCTCRCTCCGGATCTCGCTCCGG | Arrhythmogenic right ventricular cardiomyopathy, type 8 |
| 397516943 | DSP | NM_004415.2(DSP): c.478C>T (p.Arg160Ter) | CCATCAGTGTCCCTYGAGTCCGC | Arrhythmogenic right ventricular cardiomyopathy, type 8, not provided |
| 767643821 | DSP | NM_004415.2(DSP): c.3805C>T (p.Arg1269Ter) | CCACTGAGCAGCGAAGGYGAGCT | not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397509411 | DYNC1H1 | NM_001376.4(DYNC1H1): c.10151G>A (p.Arg3384Gln) | AATCRGGCTTCCCTGGCTTGCGG | Mental retardation, autosomal dominant 13 |
| 387906740 | DYNC1H1 | NM_001376.4(DYNC1H1): c.4552G>A (p.Glu1518Lys) | TGAARAGGATGCTCTCAGCTGGG, TTGAARAGGATGCTCTCAGCTGG | Mental retardation, autosomal dominant 13 |
| 201479015 | DYNC2H1 | NM_001080463.1(DYNC2H1): c.11747G>A (p.Gly3916Asp) | TAGRTGCCAAAGATGTACAATGG | Short-rib thoracic dysplasia 3 with or without polydactyly, not provided |
| 367643250 | DYRK1B | NM_004714.2(DYRK1B): c.304C>T (p.Arg102Cys) | CACTGCRCACGATGTAGTCATGG | Abdominal obesity-metabolic syndrome 3 |
| 794727343 | DYSF | NM_003494.3(DYSF): c.1956G>A (p.Trp652Ter) | CTGRGGTAACGTGAAACCTGTGG | Miyoshi muscular dystrophy 1, Limb-girdle muscular dystrophy, type 2B, Myopathy, distal, with anterior tibial onset |
| 201869739 | DYSF | NM_003494.3(DYSF): c.937+1G>A | CCCRTGAGTTCTCACCACTTTGG | Limb-girdle muscular dystrophy, type 2B, not provided |
| 745891180 | DYSF | NM_003494.3(DYSF): c.5057+5G>A | GTGTGTACRTGGATGGGGCTGG | Limb-girdle muscular dystrophy, type 2B |
| 398123763 | DYSF | NM_003494.3(DYSF): c.1053+1G>A | GCCTRTGAGTACATTTCCCTGGG, CGCCTRTGAGTACATTTCCCTGG | Limb-girdle muscular dystrophy, type 2B, not provided |
| 398123794 | DYSF | NM_003494.3(DYSF): c.5509G>A (p.Asp1837Asn) | TGAGCRACATTTATGTGAAAGGG, ATGAGCRACATTTATGTGAAAGG | Limb-girdle muscular dystrophy, type 2B, not provided |
| 794727636 | DYSF | NM_003494.3(DYSF): c.265C>T (p.Arg89Ter) | CCAAGGTCCCACTCYGAGAGGTC | Miyoshi muscular dystrophy 1, Limb-girdle muscular dystrophy, type 2B |
| 727503911 | DYSF | NM_003494.3(DYSF): c.3832C>T (p.Gln1278Ter) | CCTCTTTTGAGCTCATCYAGAGA | Limb-girdle muscular dystrophy, type 2B, not provided |
| 398123773 | DYSF | NM_003494.3(DYSF): c.2311C>T (p.Gln771Ter) | CCCTGCAGCTCTGGAGYAGGCGG, CCTGCAGCTCTGGAGYAGGCGGA | Limb-girdle muscular dystrophy, type 2B, not provided |
| 398123789 | DYSF | NM_003494.3(DYSF): c.4756C>T (p.Arg1586Ter) | CCGTATCTACATTGTCYGAGCAT | Miyoshi muscular dystrophy 1, Limb-girdle muscular dystrophy, type 2B, not provided |
| 397514594 | EARS2 | NM_001083614.1(EARS2): c.500G>A (p.Cys167Tyr) | TCGGTRCAGGAACATGAGCCAGG | Combined oxidative phosphorylation deficiency 12 |
| 376103091 | EARS2 | NM_001083614.1(EARS2): c.322C>T (p.Arg108Trp) | CCCCRGCGGGGCTCTCATCAGG | Combined oxidative phosphorylation deficiency 12 |
| 104894792 | EBP | NM_006579.2(EBP): c.386G>A (p.Trp129Ter) | TGTRGGGACCACTCAGCCTGTGG | Chondrodysplasia punctata 2 X-linked dominant |
| 104894794 | EBP | NM_006579.2(EBP): c.587G>A (p.Trp196Ter) | GCCCTGTRGCTGGTGCTGCCTGG | Chondrodysplasia punctata 2 X-linked dominant |
| 104894798 | EBP | NM_006579.2(EBP): c.87G>A (p.Trp29Ter) | CCCACCTGRCATATACTGGCTGG | Chondrodysplasia punctata 2 X-linked dominant |
| 104894799 | EBP | NM_006579.2(EBP): c.187C>T (p.Arg63Ter) | CCCATTGGGGACTTGGCGGYGAC, CCATTGGGGACTTGGCGGYGACT | Chondrodysplasia punctata 2 X-linked dominant |
| 587783613 | EBP | NM_006579.2(EBP): c.328C>T (p.Arg110Ter) | CCAAGGGAGACAGCYGATACATC | Chondrodysplasia punctata 2 X-linked dominant |
| 587776498 | ECHS1 | NM_004092.3(ECHS1): c.5C>T (p.Ala2Val) | CCAGAGAGCCATGGYCGCCCTGC | Leigh disease, MITOCHONDRIAL SHORT-CHAIN ENOYL-CoA HYDRATASE 1 DEFICIENCY |
| 121909114 | ECM1 | NM_004425.3(ECM1): c.1036C>T (p.Gln346Ter) | CCAGCTGGAGAGGGAGTTCYAGC | Lipid proteinosis |
| 121909115 | ECM1 | NM_004425.3(ECM1): c.157C>T (p.Arg53Ter) | CCCCTCCCCACCCCTATCCYGAA, CCCTCCCCACCCCTATCCYGAAG, CCTCCCCACCCCTATCCYGAAGC, CCCCACCCCTATCCYGAAGCCTC | Lipid proteinosis |
| 397516677 | EDA | NM_001399.4(EDA): c.871G>A (p.Gly291Arg) | CAGCRGGGAGCTGGAGGTACTGG | Hypohidrotic X-linked ectodermal dysplasia |
| 727504537 | EDA | NM_001399.4(EDA): c.396+1G>A | CCAGRTGAGTCACCTAGTAGGGG, ACCAGRTGAGTCACCTAGTAGGG, CACCAGRTGAGTCACCTAGTAGG | Hypohidrotic X-linked ectodermal dysplasia |
| 132630310 | EDA | NM_001399.4(EDA): c.67C>T (p.Gln23Ter) | CCGCGGGAGCGAGGGAGCYAGGG | Hypohidrotic X-linked ectodermal dysplasia |
| 132630315 | EDA | NM_001399.4(EDA): c.626C>T (p.Pro209Leu) | CCAGGGATTCCTGGAATTCYAGG | Hypohidrotic X-linked ectodermal dysplasia, not specified |
| 727503007 | EDA | NM_001399.4(EDA): c.676C>T (p.Gln226Ter) | CCAGGTCCTCCTGGTCCTYAAGG | Hypohidrotic X-linked ectodermal dysplasia |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908450 | EDAR | NM_022336.3(EDAR): c.266G>A (p.Arg89His) | AGGCRTCACAAAGACTGTGAGGG CAGGCRTCACAAAGACTGTGAGG | Autosomal recessive hypohidrotic ectodermal dysplasia syndrome |
| 121908453 | EDAR | NM_022336.3(EDAR): c.1259G>A (p.Arg420Gln) | GATTGAGCRGCTGGATGCTGTGG | Autosomal dominant hypohidrotic ectodermal dysplasia |
| 121908452 | EDAR | NM_022336.3(EDAR): c.1072C>T (p.Arg358Ter) | CCTCGAGAAGACTAGCYGAATGC | |
| 74315309 | EDARADD | NM_080738.3(EDARADD): c.424G>A (p.Glu142Lys) | CTATGACRAATTGTGCTTCCTGG | Autosomal recessive hypohidrotic ectodermal dysplasia syndrome, Ectodermal dysplasia 11b, hypohidrotic/hair/tooth type, autosomal recessive |
| 121434491 | EFEMP1 | NM_001039348.2(EFEMP1): c.1033C>T (p.Arg345Trp) | CCACAAATGAATGCYGGGAGGAT | Doyne honeycomb retinal dystrophy, Malattia leventinese |
| 193302866 | EFEMP2 | NM_016938.4(EFEMP2): c.800G>A (p.Cys267Tyr) | TTCTCCTRCCACTGCCCACAGGG, TTTCTCCTRCCACTGCCCACAGG | Autosomal recessive cutis laxa type IA, Autosomal recessive cutis laxa type 1B |
| 119489102 | EFEMP2 | NM_016938.4(EFEMP2): c.835C>T (p.Arg279Cys) | CCAGCTGCTGGCCACAYGCCTCT | Autosomal recessive cutis laxa type IA, Autosomal recessive cutis laxa type 1B |
| 387906878 | EFTUD2 | NM_004247.3(EFTUD2): c.2770C>T (p.Gln924Ter) | CCGCCCCTTGGAGCCAYAGCCAG | Growth and mental retardation, mandibulofacial dysostosis, microcephaly, and cleft palate |
| 104894161 | EGR2 | NM_000399.3(EGR2): c.1075C>T (p.Arg359Trp) | CCGCTCTGACGAGCTGACAYGGC | Dejerine-Sottas disease, Charcot-Marie-Tooth disease, type 1D |
| 587777208 | EIF2AK4 | NM_001013703.3(EIF2AK4): c.3448C>T (p.Arg1150Ter) | CCGCGCAAGTTAGATYGATTTCA | Familial pulmonary capillary hemangiomatosis |
| 104894427 | EIF2B2 | NM_014239.3(EIF2B2): c.547C>T (p.Arg183Ter) | CCTCAAAGAGGCTGCCYGAAAGA | Ovarioleukodys trophy |
| 113994033 | EIF2B4 | NM_001034116.1(EIF2B4): c.1070G>A (p.Arg357Gln) | GCGGTTTCRGGTGGTAGTGGTGG | Leukoencephalopathy with vanishing white matter |
| 113994037 | EIF2B4 | NM_001034116.1(EIF2B4): c.1191+1G>A | AGAGRTAAGTACAGAGGAAAAGG | Leukoencephalopathy with vanishing white matter |
| 113994027 | EIF2B4 | NM_001034116.1(EIF2B4): c.683C>T (p.Ala228Val) | CCAATGCCCGGTGTATTGYCCTG | Leukoencephalopathy with vanishing white matter |
| 113994055 | EIF2B5 | NM_003907.2(EIF2B5): c.583C>T (p.Arg195Cys) | CCCCCAGCCACCCAACTYGTTGC, CCCCAGCCACCCAACTYGTTGCC, CCCAGCCACCCAACTYGTTGCCA, CCAGCCACCCAACTYGTTGCCAC | Ovarioleukodystrophy |
| 119484086 | ELAC2 | NM_018127.6(ELAC2): c.2342G>A (p.Arg781His) | GGAGGAGCRCAGGGAGAAGCGGG | Prostate cancer, hereditary, 2 |
| 137854450 | ELANE | NM_001972.2(ELANE): c.377C>T (p.Ser126Leu) | CCGCCACAGCTCAACGGGTYGGC, CCACAGCTCAACGGGTYGGCCAC | Severe congenital neutropenia autosomal dominant |
| 727503035 | ELN | NM_000501.3(ELN): c.1918+1G>A | GTTTGRTGAGCACTGGGTGGAGG, CCAGTTTGRTGAGCACTGGGTGG | Supravalvar aortic stenosis |
| 137854452 | ELN | NM_000501.3(ELN): c.1324C>T (p.Gln442Ter) | CCTTGTAGCCGAAGCTYAGGCAG | Supravalvar aortic stenosis |
| 515726212 | EPB42 | NM_000119.2(EPB42): c.949C>T (p.Arg317Cys) | CCACGCRGGCAGGGATTCCCAGG | Spherocytosis type 5 |
| 267606785 | EPCAM | NM_002354.2(EPCAM): c.197G>A (p.Cys66Tyr) | TGCCAAATRTTTGGTGATGAAGG | Diarrhea 5, with tufting enteropathy, congenital |
| 116506614 | EPHA2 | NM_004431.3(EPHA2): c.2162G>A (p.Arg721Gln) | CCAGCTGCGATGCCCYGCAGCAT | |
| 28933368 | ERBB2 | NM_001005862.2(ERBB2): c.2650G>A (p.Glu884Lys) | GTGGRAGCTGATGACTTTTGGGG, TGTGGRAGCTGATGACTTTTGGG, GTGTGGRAGCTGATGACTTTTGG | Glioma susceptibility 1 |
| 121913023 | ERCC2 | NM_000400.3(ERCC2): c.2041G>A (p.Asp681Asn) | GCCRACAAGGTGCAGCTTCAGGG, TGCCRACAAGGTGCAGCTTCAGG | Cerebrooculofacioskeletal syndrome 2 |
| 41556519 | ERCC2 | NM_000400.3(ERCC2): c.2047C>T (p.Arg683Trp) | CCTGCGCTTCTGCCCACAGYGGT | Xeroderma pigmentosum, group D |
| 121913017 | ERCC2 | NM_000400.3(ERCC2): c.2176C>T (p.Gln726Ter) | CCTGCGGCAGATGGCAYAGCCCT | Xeroderma pigmentosum, group D |
| 121913021 | ERCC2 | NM_000400.3(ERCC2): c.1972C>T (p.Arg658Cys) | CCTTCGATGCCATGYGCCACGCG | Photosensitive trichothiodystrophy |
| 121913024 | ERCC2 | NM_000400.3(ERCC2): c.1846C>T (p.Arg616Trp) | CCAGTGCACCACTACGGGYGGGC | Cerebro-oculo-facio-skeletal syndrome, Xeroderma pigmentosum, group D, Cerebrooculofacioskeletal syndrome 2 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121913026 | ERCC2 | NM_000400.3(ERCC2): c.2164C>T (p.Arg722Trp) | CCAAGTACTTCCTGYGGCAGATG | Photosensitive trichothiodystrophy |
| 121913047 | ERCC3 | NM_000122.1(ERCC3): c.1273C>T (p.Arg425Ter) | CCTGGGAGGCCGAGYGAGTCATG | Xeroderma pigmentosum, complementation group b |
| 121917904 | ERCC6 | NM_000124.3(ERCC6): c.2047C>T (p.Arg683Ter) | CCGATGCAAAATAACCTCYGAGA | Cerebro-oculo-facio-skeletal syndrome |
| 121434325 | ERCC8 | NM_000082.3(ERCC8): c.479C>T (p.Ala160Val) | CCAAGCACTGTTTGGTAGYAGGT | Cockayne syndrome type A, not provided |
| 587777006 | ERF | NM_006494.3(ERF): c.547C>T (p.Arg183Ter) | TGAGCCTCRGCCCAGGCGGCGGG | Craniosynostosis 4 |
| 587777010 | ERF | NM_006494.3(ERF): c.1270C>T (p.Gln424Ter) | TCTRTGGTGGCGGGGCGGTGGG, ATCTRTGGTGGCGGGGCGGTGG, TTGATCTRTGGTGGCGGGGCGG | Craniosynostosis 4 |
| 56025238 | ERMAP | NM_001017922.1(ERMAP): c.169G>A (p.Gly57Arg) | GCCCRGGACGGTACCCAAGGAGG, CTGGCCCRGGACGGTACCCAAGG | |
| 80359865 | ESCO2 | NM_001017420.2(ESCO2): c.1354-18G>A | TCTTRGTTTTTAAAATCATTAGG | Roberts-SC phocomelia syndrome |
| 80359850 | ESCO2 | NM_001017420.2(ESCO2): c.604C>T (p.Gln202Ter) | CCAAAAAATAAAACCAYAAGTTA | Roberts-SC phocomelia syndrome |
| 121908136 | ESPN | NM_031475.2(ESPN): c.2321G>A (p.Arg774Gln) | GGCRGAAGGTGGGTGGGGCGGGG, AGGCRGAAGGTGGGTGGGGCGGG, GAGGCRGAAGGTGGGTGGGGCGG, GCAGAGGCRGAAGGTGGGTGGGG | Deafness, without vestibular involvement, autosomal dominant |
| 104893956 | ESR1 | NM_001122742.1(ESR1): c.469C>T (p.Arg157Ter) | CCAAATTCAGATAATYGACGCCA | Estrogen resistance |
| 119458971 | ETFA | NM_000126.3(ETFA): c.346G>A (p.Gly116Arg) | CTGCCTTCRGAAAGGTGAGAAGG | Glutaric acidemia IIA |
| 104894677 | ETFB | NM_001985.2(ETFB): c.491G>A (p.Arg164Gln) | GTGGAGCRGGAGATCGATGGGGG, AGTGGAGCRGGAGATCGATGGGG | Glutaric acidemia IIB |
| 796051960 | ETFDH | NM_004453.3(ETFDH): c.1809G>A (p.Trp603Ter) | AACTGRGTGGTACCTGAAGGTGG, ATTAACTGRGTGGTACCTGAAGG | not provided |
| 724159946 | ETV6 | NM_001987.4(ETV6): 6G>A (p.Arg369Gln) | TTCCRGATAGTGGATCCCAACGG | Hematologic neoplasm, Thrombocytopenia, Thrombocytopenia 5 |
| 724159947 | ETV6 | NM_001987.4(ETV6): c.641C>T (p.Pro214Leu) | CCGCCGCCTCTCCCYGGCTGAGA | Hematologic neoplasm, Thrombocytopenia, Thrombocytopenia 5 |
| 121909199 | EYA1 | NM_000503.5(EYA1): c.1276G>A (p.Gly426Ser) | GTGTACGGRGCGGTGTGGACTGG | |
| 527236064 | EYS | NM_001142800.1(EYS): c.7793G>A (p.Gly2598Asp) | CCTGAGGRCCACCCAAATGCTGG | Retinitis pigmentosa |
| 794727631 | EYS | NM_001142800.1(EYS): c.490C>T (p.Arg164Ter) | CCTTGTCCACTGGGACTTYGACT | Retinitis pigmentosa 25 |
| 587783625 | EZH2 | NM_004456.4(EZH2): c.1876G>A (p.Val626Met) | CATCTGACRTGGCAGGCTGGGGG | Weaver syndrome |
| 61753266 | F10 | NM_000504.3(F10): c.424G>A (p.Glu142Lys) | CCACRAGGAACAGAACTCTGTGG | Factor X deficiency |
| 121913071 | F13A1 | NM_000129.3(F13A1): c.782G>A (p.Arg261His) | CAGCCRTGTGGGGTCTGCAATGG | Factor xiii, a subunit, deficiency of |
| 121913065 | F13A1 | NM_000129.3(F13A1): c.514C>T (p.Arg172Ter) | CCCTATGGCGTACTTYGAACCAG, CCTATGGCGTACTTYGAACCAGT | Factor xiii, a subunit, deficiency of |
| 267606787 | F13A1 | NM_000129.3(F13A1): c.2110C>T (p.Arg704Trp) | CCCTGGGTCTCTGGGCATYGGAA, CCTGGGTCTCTGGGCATYGGAAG | Factor xiii, a subunit, deficiency of |
| 267606789 | F13A1 | NM_000129.3(F13A1): c.1984C>T (p.Arg662Ter) | CCTTTAAAAGAAACCCTGYGAAA | Factor xiii, a subunit, deficiency of |
| 21918482 | F2 | NM_000506.3(F2): c.1292G1>A (p.Arg431His) | TCCCRCACCAGGTACAGAACTGG | |
| 121918483 | F2 | NM_000506.3(F2): c.1027G>A (p.Glu343Lys) | GTTCRAGAAGAAGTCGCTGGAGG | Hereditary factor II deficiency disease |
| 121918484 | F2 | NM_000506.3(F2): c.1054G>A (p.Glu352Lys) | TCTGTTCRAGAAGAAGTCGCTGG, CAAAACCRAAAGAGAGCTCCTGG | Hereditary factor II deficiency disease |
| 386834228 | F5 | NM_000130.4(F5): c.5668G>A (p.Glu1890Lys) | TTGGARAAAACCAGAAGAGCAGG, GTTGGARAAAACCAGAGAGCAGG | not provided |
| 36209567 | F7 | NM_000131.4(F7): c.1061C>T (p.Ala354Val) | CCGTGGCGCCACGGYCCTGGAGC | Factor VII deficiency |
| 137852373 | F8 | NM_000132.3(F8): c.5167G>A (p.Glu1723Lys) | GTGRAGAGGCTCTGGGATTATGG | Hereditary factor VIII deficiency disease |
| 137852466 | F8 | NM_000132.3(F8): c.6545G>A (p.Arg2182His) | ACTCTTCRCATGGAGTTGATGGG, CACTCTTCRCATGGAGTTGATGG | Hereditary factor VIII deficiency disease |
| 28933681 | F8 | NM_000132.3(F8): c.5710G>A (p.Glu1904Lys) | TCTTTGATRAGACCAAAAGCTGG | Hereditary factor VIII deficiency disease |
| 137852357 | F8 | NM_000132.3(F8): c.6496C>T (p.Arg2166Ter) | CCCTCCAATTATTGCTYGATACA, CCTCCAATTATTGCTYGATACAT | Hereditary factor VIII deficiency disease |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137852364 | F8 | NM_000132.3(F8): c.1171C>T (p.Arg391Cys) | CCTTCCTTTATCCAAATTYGCTC, CCTTTATCCAAATTYGCTCAGTT | Hereditary factor VIII deficiency disease |
| 137852368 | F8 | NM_000132.3(F8): c.1063C>T (p.Arg355Ter) | CCAGAGGAACCCCAACTAYGAAT | Hereditary factor VIII deficiency disease |
| 137852393 | F8 | NM_000132.3(F8): c.493C>T (p.Pro165Ser) | CCTGAAAGAGAATGGTYCAATGG | Hereditary factor VIII deficiency disease |
| 137852401 | F8 | NM_000132.3(F8): c.881C>T (p.Thr294Ile) | CCTCGAAGGTCACAYATTTCTTG | Hereditary factor VIII deficiency disease |
| 137852416 | F8 | NM_000132.3(F8): c.1636C>T (p.Arg546Trp) | CCAACTAAATCAGATCCTYGGTG | Hereditary factor VIII deficiency disease |
| 137852428 | F8 | NM_000132.3(F8): c.1834C>T (p.Arg612Cys) | CCTCACAGAGAATATACAAYGCT | Hereditary factor VIII deficiency disease |
| 137852435 | F8 | NM_000132.3(F8): c.2149C>T (p.Arg717Trp) | CCACAACTCAGACTTTYGGAACA | Hereditary factor VIII deficiency disease |
| 137852445 | F8 | NM_000132.3(F8): c.5422C>T (p.Leu1808Phe) | CCTTCTATTCTAGCYTTATTTCT | Hereditary factor VIII deficiency disease |
| 137852453 | F8 | NM_000132.3(F8): c.6046C>T (p.Arg2016Trp) | CCAAAGCTGGAATTTGGYGGGTG | Hereditary factor VIII deficiency disease |
| 137852456 | F8 | NM_000132.3(F8): c.6263C>T (p.Ser2088Phe) | CCAAGGAGCCCTTTTYTTGGATC | Hereditary factor VIII deficiency disease |
| 137852463 | F8 | NM_000132.3(F8): c.6518C>T (p.Thr2173Ile) | CCGTTTGCACCCAAYTCATTATA | Hereditary factor VIII deficiency disease |
| 137852464 | F8 | NM_000132.3(F8): c.6532C>T (p.Arg2178Cys) | CCCAACTCATTATAGCATTYGCA, CCAACTCATTATAGCATTYGCAG | Hereditary factor VIII deficiency disease |
| 137852473 | F8 | NM_000132.3(F8): c.6967C>T (p.Arg2323Cys) | CCCACCGTTACTGACTYGCTACC, CCACCGTTACTGACTYGCTACCT | Hereditary factor VIII deficiency disease |
| 137852257 | F9 | NM_000133.3(F9): c.1069G>A (p.Gly357Arg) | TGGRGAAGAGTCTTCCACAAAGG | Hereditary factor IX deficiency disease |
| 137852267 | F9 | NM_000133.3(F9): c.1324G>A (p.Gly442Arg) | CAAATATRGAATATATACCAAGG | Hereditary factor IX deficiency disease |
| 137852275 | F9 | NM_000133.3(F9): c.1070G>A (p.Gly357Glu) | GGGRAAGAGTCTTCCACAAAGGG, TGGGRAAGAGTCTTCCACAAAGG | Hereditary factor IX deficiency disease |
| 137852272 | F9 | NM_000133.3(F9): c.484C>T (p.Arg162Ter) | CCTGTACTGAGGGATATYGACTT | Hereditary factor IX deficiency disease |
| 387907040 | FA2H | NM_024306.4(FA2H): c.460C>T (p.Arg154Cys) | CCGGTGACCAGGCCCATCYGCCT | Spastic paraplegia 35 |
| 80338901 | FAH | NM_000137.2(FAH):1062 c.1062+5G>A | TGARTATCTGGCTGCACTGAGGG, GTGARTATCTGGCTGCACTGAGG | Tyrosinemia type I, not provided |
| 587777011 | FAM111A | NM_001142519.1(FAM111A): c.1706G>A (p.Arg569His) | ACTCRTAGTATCATTGAGTTTGG | Kenny-Caffey syndrome type 2 |
| 587777238 | FAM111B | NM_198947.3(FAM111B): c.1883G>A (p.Ser628Asn) | GAARTTTCCTATCAGAGGTTTGG, CCAAAGAARTTTCCTATCAGAGG | Poikiloderma, hereditary fibrosing, with tendon contractures, myopathy, and pulmonary fibrosis |
| 137852737 | FAM134B | NM_001034850.2(FAM134B): c.433C>T (p.Gln145Ter) | CCCTGTTGCAGGTGCAYAGTTGT, CCTGTTGCAGGTGCAYAGTTGTG | Hereditary sensory and autonomic neuropathy type IIB, Hereditary sensory and autonomic neuropathy type IIA |
| 796051850 | FAM20C | NM_020223.3(FAM20C): c.1645C>T (p.Arg549Trp) | CCTGGAGGCCCTGGACCGGYGGC | Raine syndrome |
| 137854435 | FAM83H | NM_198488.3(FAM83H): c.973C>T (p.Arg325Ter) | CCCCTTCTCCTTCCCTAAAYGAG, CCCTTCTCCTTCCCTAAAYGAGC, CCTTCTCCTTCCCTAAAYGAGCG | Amelogenesis imperfecta, hypocalcification type |
| 137854440 | FAM83H | NM_198488.3(FAM83H): c.2029C>T (p.Gln677Ter) | CCTGAACCCCTGGTCYAGCGCA | Amelogenesis imperfecta, hypocalcification type |
| 387907056 | FAM83H | NM_198488.3(FAM83H): c.1366C>T (p.Gln456Ter) | CCGTGACCAGCTCTACCAGYAGC | Amelogenesis imperfecta, hypocalcification type |
| 730881731 | FANCC | NM_000136.2(FANCC): c.319C>T (p.Gln107Ter) | CCACAGAATTCTGGAYAATCAAA | Hereditary cancer-predisposing syndrome |
| 121434506 | FANCE | NM_021922.2(FANCE): c.421C>T (p.Arg141Ter) | CCCTGGGGAATTGCTGYGAAGG, CCTGGGGAATTGCTGYGAAGGG | Fanconi anemia, complementation group E |
| 121918163 | FANCI | NM_001113378.1(FANCI): c.3854G>A (p.Arg1285Gln) | TCACRAGACTTCAAGATCAAAGG | Fanconi anemia, complementation group I |
| 121913077 | FAS | NM_000043.4(FAS): c.817C>T (p.Gln273Ter) | CCAAGCACAGCAGAAYAGAAAG | Autoimmune lymphoproliferative syndrome, type 1a |
| 398122955 | FAT4 | NM_024582.4(FAT4): c.7123G>A (p.Glu2375Lys) | ATTCCTRAGGATGCACCAACTGG | Van Maldergem syndrome 2, Hennekam lymphangiectasia-lymphedema syndrome 2 |
| 80338765 | FBLN5 | NM_006329.3(FBLN5): c.604G>A (p.Gly202Arg) | GAGGATRGAAGGTCTTGCCAAGG | Autosomal recessive cutis laxa type IA |
| 28939073 | FBLN5 | NM_006329.3(FBLN5): c.1051C>T (p.Arg351Trp) | CCCTTTACCATCTTGTACYGGGA, CCTTTACCATCTTGTACYGGGAC | Age-related macular degeneration 3 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 193922236 | FBN1 | NM_000138.4(FBN1): c.7806G>A (p.Trp2602Ter) | TACCAGTGRAACCAGTGTGTTGG | Thoracic aortic aneurysms and aortic dissections, Marfan syndrome |
| 794728166 | FBN1 | NM_000138.4(FBN1): c.1421G>A (p.Cys474Tyr) | ACCGGTRTGAGTGCAACAAAGGG, TACCGGTRTGAGTGCAACAAAGG | Thoracic aortic aneurysms and aortic dissections |
| 794728170 | FBN1 | NM_000138.4(FBN1): c.1583G>A (p.Cys528Tyr) | AGAATRCCGAGGTATGGTCCTGG | Thoracic aortic aneurysms and aortic dissections |
| 794728237 | FBN1 | NM_000138.4(FBN1): c.5699G>A (p.Cys1900Tyr) | CCTRTGGGAATGGAACTTGCCGG | Thoracic aortic aneurysms and aortic dissections |
| 794728240 | FBN1 | NM_000138.4(FBN1): c.5801G>A (p.Cys1934Tyr) | ATGAATRTGCAAGTGGAAATGGG, GATGAATRTGCAAGTGGAAATGG | Thoracic aortic aneurysms and aortic dissections |
| 794728257 | FBN1 | NM_000138.4(FBN1): c.6871G>A (p.Asp2291Asn) | TGTARGTAAGAGGATCCCTGTGG | Thoracic aortic aneurysms and aortic dissections |
| 794728266 | FBN1 | NM_000138.4(FBN1): c.7205-1G>A | TACARATATCGATGAATGCAAGG | Thoracic aortic aneurysms and aortic dissections |
| 397515757 | FBN1 | NM_000138.4(FBN1): c.1468+5G>A | GTACRTGATCCATCCTAGGTTGG, ATTGGTACRTGATCCATCCTAGG | Thoracic aortic aneurysms and aortic dissections, Marfan syndrome |
| 397515804 | FBN1 | NM_000138.4(FBN1): c.4259G>A (p.Cys1420Tyr) | CAGTRCCTCAATGCACCAGGAGG, GGCCAGTRCCTCAATGCACCAGG | Thoracic aortic aneurysms and aortic dissections, Marfan syndrome |
| 397515859 | FBN1 | NM_000138.4(FBN1): c.7955G>A (p.Cys2652Tyr) | CAATGAATRTGGCTCTGCGCAGG | Thoracic aortic aneurysms and aortic dissections, Marfan syndrome |
| 775417975 | FBN1 | NM_000138.4(FBN1): c.3513C>A (p.Cys1171Ter) | GGTTCACRCAACGGCCATTGGGG, AGGTTCACRCAACGGCCATTGGG | Thoracic aortic aneurysms and aortic dissections |
| 794728335 | FBN1 | NM_000138.4(FBN1): c.6425G>A (p.Cys2142Tyr) | GGACAGTRCATCAATACAGATGG | Thoracic aortic aneurysms and aortic dissections |
| 548296552 | FBN1 | NM_000138.4(FBN1): c.2926C>T (p.Arg976Cys) | ATGCRGTGGCGGCCAGCAATAGG | Thoracic aortic aneurysms and aortic dissections |
| 137854475 | FBN1 | NM_000138.4(FBN1): c.3509G>A (p.Arg1170His) | GCCRTTGCGTGAACCTCATAGGG, GGCCRTTGCGTGAACCTCATAGG | Thoracic aortic aneurysms and aortic dissections, Marfan syndrome, Marfanoid habitus, not specified, not provided |
| 137854482 | FBN1 | NM_000138.4(FBN1): c.3386G>A (p.Cys1129Tyr) | GGTGTTTRCCATAACACAGAGGG, TGGTGTTTRCCATAACACAGAGG | Marfan syndrome |
| 137854483 | FBN1 | NM_000138.4(FBN1): c.3662G>A (p.Cys1221Tyr) | TATGAATRTAGCTGTCAGCCGGG, CTATGAATRTAGCTGTCAGCCGG | Marfan syndrome |
| 137854484 | FBN1 | NM_000138.4(FBN1): c.3257G>A (p.Cys1086Tyr) | CCAGTRTGTGAACACCCCTGGGG, GCCAGTRTGTGAACACCCCTGGG, GGCCAGTRTGTGAACACCCCTGG | |
| 369294972 | FBN1 | NM_000138.4(FBN1): c.7660C>T (p.Arg2554Trp) | GAATCCCCRCTGGCATTCACAGG | Thoracic aortic aneurysms and aortic dissections, Marfan syndrome, incomplete |
| 113871094 | FBN1 | NM_000138.4(FBN1): c.4786C>T (p.Arg1596Ter) | CCTGGAGGGGAAGGTTTCYGACC | Thoracic aortic aneurysms and aortic dissections, Marfan syndrome |
| 794728262 | FBN1 | NM_000138.4(FBN1): c.7003C>T (p.Arg2335Trp) | CCCTTCCAGACAATYGGGAAGGG | Thoracic aortic aneurysms and aortic dissections |
| 730880099 | FBN1 | NM_000138.4(FBN1): c.1633C>T (p.Arg545Cys) | CCGGATCTGCAATAATGGAYGCT | Marfan syndrome |
| 794728195 | FBN1 | NM_000138.4(FBN1): c.2645C>T (p.Ala882Val) | CCTCCCTCGGTGCTGYGTGGGA | Thoracic aortic aneurysms and aortic dissections |
| 794728196 | FBN1 | NM_000138.4(FBN1): c.2671C>T (p.Gln891Ter) | CCCGTGCACCCTATGCYAAGTTG, CCGTGCACCCTATGCYAAGTTGG | Thoracic aortic aneurysms and aortic dissections |
| 794728231 | FBN1 | NM_000138.4(FBN1): c.4888C>T (p.Gln1630Ter) | CCTTTGGGAGTTTCYAGTGCCGC | Thoracic aortic aneurysms and aortic dissections |
| 397514558 | FBN1 | NM_000138.4(FBN1): c.2920C>T (p.Arg974Cys) | CCCTGCCTATTGCTGGCYGCCAC, CCTGCCTATTGCTGGCYGCCACC | Marfan syndrome, Ectopia lentis, isolated, autosomal dominant |
| 794728283 | FBN1 | NM_000138.4(FBN1): c.8038C>T (p.Arg2680Cys) | CCACCTGGTTACTTCYGCATAGG | Thoracic aortic aneurysms and aortic dissections |
| 140630 | FBN1 | NM_000138.4(FBN1): c.4930C>T (p.Arg1644Ter) | CCTGAATGAAGATACAYGAGTGT | Thoracic aortic aneurysms and aortic dissections |
| 113001196 | FBN1 | NM_000138.4(FBN1): c.6658C>T (p.Arg2220Ter) | CCTCTGCTCTGTGCCTTCYGATG | Thoracic aortic aneurysms and aortic dissections, Marfan syndrome |
| 112645512 | FBN1 | NM_000138.4(FBN1): c.1285C>T (p.Arg429Ter) | CCTCAAATTCCGGTCCCTYGACC | Marfan syndrome |
| 25403 | FBN1 | NM_000138.4(FBN1): c.184C>T (p.Arg62Cys) | CCCAATGTCTGTGGATCAYGTTA, CCAATGTCTGTGGATCAYGTTAT | Marfan syndrome |
| 137852826 | FBN2 | NM_001999.3(FBN2): c.1171G>A (p.Glu391Lys) | TGTRAGCCTGGCCGCTGCTGGGG, CTGTRAGCCTGGCCGCTGCTGGG, GCTGTRAGCCTGGCCGCTGCTGG | Congenital contractural arachnodactyly |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918188 | FBP1 | NM_001127628.1(FBP1): c.490G>A (p.Gly164Ser) | GCAGCCRGCTACGCACTGTATGG | Fructose-biphosphatase deficiency |
| 398123061 | FBXL4 | NM_012160.4(FBXL4): c.1444C>T (p.Arg482Trp) | CCAAGTGTAAAAAACTCYGGACC | Mitochondrial encephalomyopathy, Mitochondrial DNA depletion syndrome 13 (encephalomyopathic type), Global developmental delay |
| 121918305 | FBXO7 | NM_012179.3(FBXO7): c.65C>T (p.Thr22Met) | CCCGAGACGGAGCCGAYGCTGGG, CCCGAGACGGAGCCGAYGCTGGGG | Parkinson disease 15 |
| 267606804 | FECH | NM_001012515.2(FECH): c.1243C>T (p.Pro415Ser) | CCGCTCTGTGTCAATYCTGTCTG | Erythropoietic protoporphyria |
| 121918292 | FERMT1 | NM_017671.4(FERMT1): c.787C>T (p.Gln263Ter) | CCTTATGGAACAAGGCATCYAAG | Kindler syndrome |
| 121918296 | FERMT3 | NM_178443.2(FERMT3): c.48G>A (p.Trp16Ter) | ATGRGAGCTGCGGGTGTTTGTGG | LEUKOCYTE ADHESION DEFICIENCY, TYPE III |
| 121918298 | FERMT3 | NM_178443.2(FERMT3): c.687G>A (p.Trp229Ter) | CCAGGTGRCTGGACTCGTCGCGG | LEUKOCYTE ADHESION DEFICIENCY, TYPE III |
| 121918295 | FERMT3 | NM_178443.2(FERMT3): c.1537C>T (p.Arg513Ter) | CCCCCCGTTTCCAGYGAAAGTTC | LEUKOCYTE ADHESION DEFICIENCY, TYPE III |
| 121918297 | FERMT3 | NM_178443.2(FERMT3): c.1729C>T (p.Arg577Ter) | CCTGGGCATCGCCAACAACYGAC | LEUKOCYTE ADHESION DEFICIENCY, TYPE III |
| 121909607 | FGA | NM_000508.3(FGA): c.104G>A (p.Arg35His) | CGTGCRTGGCCCAAGGGTTGTGG | Dysfibrinogenemia |
| 606231223 | FGB | NM_005141.4(FGB): c.958+13C>T | CCAGGTAACGAACAGGYATGCAA | Afibrinogenemia, congenital |
| 28935498 | FGD1 | NM_004463.2(FGD1): c.935C>T (p.Pro312Leu) | CCCAGCCACAGCCTCTGCCYTGG, CCAGCCACAGCCTCTGCCYTGGG, CCACAGCCTCTGCCYTGGGCCCC | Syndromic X-linked mental retardation 16 |
| 387906718 | FGD1 | NM_004463.2(FGD1): c.1966C>T (p.Arg656Ter) | CCAACCTCAATCTGCCYTGAACC | Aarskog syndrome |
| 118203974 | FGD4 | NM_139241.3(FGD4): c.823C>T (p.Arg275Ter) | CCAGAGCTGGAGAAAYGAATGCA | Charcot-Marie-Tooth disease, type 4H |
| 121917704 | FGF3 | NM_005247.2(FGF3): c.310C>T (p.Arg104Ter) | CCATGAACAAGAGGGGAYGACTC | Deafness with labyrinthine aplasia microtia and microdontia (LAMM) |
| 137852660 | FGF8 | NM_033163.3(FGF8): c.77C>T (p.Pro26Leu) | CCTCTAGGAAGGCCYGGGCAGGG | Kallmann syndrome 6 |
| 121918322 | FGF9 | NM_002010.2(FGF9): c.296G>A (p.Ser99Asn) | TATCARTATAGCAGTGGGCCTGG | Multiple synostoses syndrome 3 |
| 515726225 | FGFR1 | NM_023110.2(FGFR1): c.2084C>T (p.Thr695Ile) | CCAGARTGAAGATCTCCCACAGG | Kallmann syndrome 2 |
| 121909636 | FGFR1 | NM_023110.2(FGFR1): c.2038C>T (p.Gln680Ter) | CCGGATCTACACCCACYAGAGTG | Kallmann syndrome 2, Delayed puberty |
| 515726224 | FGFR1 | NM_023110.2(FGFR1): c.1460G>A (p.Gly487Asp) | CCACCTGCCCAAAGCAGYCCTCT, CCTGCCCAAAGCAGYCCTCTCCC | Kallmann syndrome 2 |
| 121918491 | FGFR2 | NM_000141.4(FGFR2): c.1032G>A (p.Ala344=) | GCTTGGCRGGTAATTCTATTGGG, TGCTTGGCRGGTAATTCTATTGG | Crouzon syndrome, Craniosynostosis |
| 121918509 | FGFR2 | NM_000141.4(FGFR2): c.1882G>A (p.Ala628Thr) | TTTARCAGCCAGAAATGTTTTGG | |
| 121913112 | FGFR3 | NM_000142.4(FGFR3): c.1537G>A (p.Asp513Asn) | CACAGACRATGCCACTGACAAGG | |
| 351855 | FGFR4 | NM_213647.2(FGFR4): c.1162G>A (p.Gly388Arg) | CCTGCCCTCGATACAGCCYGGCC, CCCTCGATACAGCCYGGCCAGCA | |
| 104894689 | FKRP | NM_024301.4(FKRP): c.764G>A (p.Trp255Ter) | CGCTRGAAGGCTGAGCGCGAGGG, GCGCTRGAAGGCTGAGCGCGAGG | Limb-girdle muscular dystrophy-dystroglycanopathy, type C5 |
| 104894681 | FKRP | NM_024301.4(FKRP): c.1343C>T (p.Pro448Leu) | CCCGAGCACTTCCTGCAGCYGCT, CCGAGCACTTCCTGCAGCYGCTG | Congenital muscular dystrophy-dystroglycanopathy without mental retardation, type B5 |
| 104894690 | FKRP | NM_024301.4(FKRP): c.400C>T (p.Arg134Trp) | CCAGTACCTGATGGGGCGYGGG | Limb-girdle muscular dystrophy-dystroglycanopathy, type C5 |
| 587782069 | FLCN | NM_144997.5(FLCN): c.499C>T (p.Gln167Ter) | CCTGGCCAGGGGCTTCYAGCGCT | Hereditary cancer-predisposing syndrome |
| 398124523 | FLCN | NM_144997.5(FLCN): c.1060C>T (p.Gln354Ter) | CCCTCCGGCACATGAGGYAGGTA, CCTCCGGCACATGAGGYAGGTAG | not provided |
| 398124532 | FLCN | NM_144997.5(FLCN): c.1597C>T (p.Gln533Ter) | CCCAAAGAGGACACAYAGAAGCT, CCAAAGAGGACACAYAGAAGCTG | not provided |
| 387907371 | FLNA | NM_001110556.1(FLNA): c.5217G>A (p.Thr1739=) | TGACRGTGAGGAGGGGTGGGGGG, GTGACRGTGAGGAGGGGTGGGGG, AGTGACRGTGAGGAGGGGTGGGG, AAGTGACRGTGAGGAGGGGTGGG, CAAGTGACRGTGAGGAGGGGTGG | Terminal osseous dysplasia |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28935473 | FLNA | NM_001110556.1(FLNA): c.3596C>T (p.Ser1199Leu) | CCATTGAGATCTGCTYGGAGGCG | Melnick-Needles syndrome |
| 80338841 | FLNA | NM_001110556.1(FLNA): c.1923C>T (p.Gly641=) | CCGCAGGAGGCTGGYGAGTATGC | X-linked periventricular heterotopia, Cardiac valvular dysplasia, X-linked |
| 398123614 | FLNA | NM_001110556.1(FLNA): c.2761C>T (p.Arg921Ter) | CCAAGGGGATGCAGTGYGAGAT | X-linked periventricular heterotopia, Oto-palato-digital syndrome, type I, not provided |
| 137853310 | FLNA | NM_001110556.1(FLNA): c.544C>T (p.Gln182Ter) | CCAGAACAAGCTGCCGYAGCTGC | X-linked periventricular heterotopia |
| 137853312 | FLNA | NM_001110556.1(FLNA): c.3557C>T (p.Ser1186Leu) | CCAAGTGGACTGCTYGAGCGCAG | Frontometaphyseal dysplasia |
| 137853317 | FLNA | NM_001110556.1(FLNA): c.586C>T (p.Arg196Trp) | CCGGGACTGGCAGAGCGGCYGGG | Oto-palato-digital syndrome, type I, Oto-palato-digital syndrome, type II, not provided |
| 80356510 | FLNB | NM_001457.3(FLNB): c.1088G>A (p.Gly363Glu) | GTCCAGRGTTGGAAGCTGTAGGG, GGTCCAGRGTTGGAAGCTGTAGG | Larsen syndrome, dominant type |
| 80356513 | FLNB | NM_001457.3(FLNB): c.4756G>A (p.Gly1586Arg) | AAGACTGGCGCTATATGATTGG | Larsen syndrome, dominant type, Larsen syndrome |
| 80356517 | FLNB | NM_001457.3(FLNB): c.1945C>T (p.Arg649Ter) | CCTTTGCTTCAGGTTYGAGCATA | Spondylocarpotarsal synostosis syndrome |
| 80356519 | FLNB | NM_001457.3(FLNB): c.2452C>T (p.Arg818Ter) | CCTCCTGCTGCTGGGYGATACAC | Spondylocarpotarsal synostosis syndrome |
| 121909654 | FLT4 | NM_182925.4(FLT4): c.2632G>A (p.Val878Met) | GTGGCCRTGAAAATGCTGAAAGG | Hereditary lymphedema type I |
| 121909656 | FLT4 | NM_182925.4(FLT4): c.3316G>A (p.Glu1106Lys) | CTCTGGRAGATCTTCTCTCTGGG, TCTCTGGRAGATCTTCTCTCTGG | Hereditary lymphedema type I |
| 121909657 | FLT4 | NM_182925.4(FLT4): c.2563G>A (p.Ala855Thr) | CGGCRCCTTCGGGAAGGTGGTGG, CTACGGCRCCTTCGGGAAGGTGG | Hereditary lymphedema type I |
| 34255532 | FLT4 | NM_182925.4(FLT4): c.2860C>T (p.Pro954Ser) | CCGCAGGAGAAGTCTYCCGAGCA | Hemangioma, capillary infantile |
| 267606819 | FLVCR1 | NM_014053.3(FLVCR1): c.721G>A (p.Ala241Thr) | CACCRCCGTGCTGGGCAATCAGG | Posterior column ataxia with retinitis pigmentosa |
| 72549320 | FMO3 | NM_001002294.2(FMO3): c.94G>A (p.Glu32Lys) | TTTRAGAAGAGCAATGACATTGG | Trimethylaminuria |
| 2266782 | FMO3 | NM_006894.5(FMO3): c.472G>A (p.Glu158Lys) | AAAARAGTCCTTTCCAGGTAAGG | Trimethylaminuria |
| 72549326 | FMO3 | NM_006894.5(FMO3): c.458C>T (p.Pro153Leu) | CCGGACATCATGTGTATCYCAAC | Trimethylaminuria |
| 79691946 | FOXC1 | NM_001453.2(FOXC1): c.889C>T (p.Pro297Ser) | CCGCCGCCGCCCGCGYCCTCCGC | Iridogoniodysgenesis type1, not specified, not provided |
| 104893952 | FOXC1 | NM_001453.2(FOXC1): c.67C>T (p.Gln23Ter) | CCCTACCTCGGCGGCGAGYAGAG, CCTACCTCGGCGGCGAGYAGAGC | Axenfeld-Rieger syndrome type 3 |
| 104893957 | FOXC1 | NM_001453.2(FOXC1): c.392C>T (p.Ser131Leu) | CCGCCACAACCTCTYGCTCAACG | Axenfeld-Rieger syndrome type 3 |
| 786205000 | FOXG1 | NM_005249.4(FOXG1): c.136C>T (p.Gln46Ter) | CCACAACAGCCACCACCCCYAGC | not provided |
| 786205006 | FOXG1 | NM_005249.4(FOXG1): c.610C>T (p.Leu204Phe) | CCCCGAGAAGCGGCTCACGYTCA, CCCGAGAAGCGGCTCACGYTCAA, CCGAGAAGCGGCTCACGYTCAAC | not provided |
| 796052467 | FOXG1 | NM_005249.4(FOXG1): c.701C>T (p.Ser234Phe) | CCATCCGCCACAATCTGTYCCTC, CCGCCACAATCTGTYCCTCAACA | not provided |
| 796052458 | FOXG1 | NM_005249.4(FOXG1): c.217C>T (p.Gln73Ter) | CCGCCGCCGCAGCAGCAGYAGCC, CCGCCGCAGCAGCAGYAGCCGCC | not provided |
| 387906920 | FOXL2 | NM_023067.3(FOXL2): c.205G>A (p.Glu69Lys) | TCCGCRAGAGCGCGGAGAAGAGG | |
| 104893739 | FOXL2 | NM_023067.3(FOXL2): c.586C>T (p.Gln196Ter) | CCCCCAAGTACCTGYAGTCTGG, CCCCCAAGTACCTGYAGTCTGGC | Blepharophimosis, ptosis, and epicanthus inversus |
| 104893741 | FOXL2 | NM_023067.3(FOXL2): c.655C>T (p.Gln219Ter) | CCCTATGCCTCCTGCYAGATGGC, CCTATGCCTCCTGCYAGATGGCG | Blepharophimosis, ptosis, and epicanthus inversus |
| 122467174 | FOXP3 | NM_014009.3(FOXP3): c.3G>A (p.MetIle) | CCGATRCCCAACCCCAGGCCTGG | Insulin-dependent diabetes mellitus secretory diarrhea syndrome |
| 120074156 | FRAS1 | NM_025074.6(FRAS1): c.8602C>T (p.Gln2868Ter) | CCTGGTGTCATTGAAYAGGTGCG | Cryptophthalmos syndrome |
| 137852209 | FRMD7 | NM_194277.2(FRMD7): c.252G>A (p.Val84=) | AGTRGACCCTGGACATCTGCGGG, CAGTRGACCCTGGACATCTGCGG | Infantile nystagmus, X-linked |
| 137852208 | FRMD7 | NM_194277.2(FRMD7): c.1003C>T (p.Arg335Ter) | CCCATCTCAGTACCATGAAYGAC, CCATCTCAGTACCATGAAYGACA | Infantile nystagmus, X-linked |
| 121909660 | FSHR | NM_000145.3(FSHR): c.1717C>T (p.Arg573Cys) | CCAGGATCGCCAAGYGCATGGCC | Ovarian dysgenesis 1 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28941768 | FTCD | NM_006657.2(FTCD): c.403C>T (p.Arg135Cys) | CCAGGATGGACAGTYGCCGGACC | Glutamate formiminotransferase deficiency |
| 104894685 | FTL | NM_000146.3(FTL): c.286G>A (p.Ala96Thr) | AGACRCCATGAAAGCTGCCATGG | Neuroferritinopathy |
| 397514540 | PTL | NM_000146.3(FTL): c.89C>T (p.Thr30Ile) | CCTGCAGGCCTCCTACAYCTACC | Hyperferritinemia cataract syndrome |
| 121909669 | FUS | NM_004960.3(FUS): c.1553G>A (p.Arg518Lys) | ACARACAGGATCGCAGGGAGAGG, TGAGCACARACAGGATCGCAGGG | Amyotrophic lateral sclerosis type 6 |
| 267606831 | FUS | NM_004960.3(FUS): c.1520G>A (p.Gly507Asp) | TGGCTTTGRCCCTGGCAAGATGG | Amyotrophic lateral sclerosis type 6 |
| 387906628 | FUS | NM_004960.3(FUS): c.616G>A (p.Gly206Ser) | CAGCRGTGGCTATGGACAGCAGG | Amyotrophic lateral sclerosis type 6 |
| 104894569 | G6PC | NM_000151.3(G6PC): c.551G>A (p.Gly184Glu) | GCTGRAGTCCTGTCAGGTATGGG, TGCTGRAGTCCTGTCAGGTATGG | Glycogen storage disease type 1A |
| 1801176 | G6PC | NM_000151.3(G6PC): c.248G>A (p.Arg83His) | TGGACAGCRTCCATACTGGTGGG | Glucose-6-phosphate transport defect |
| 137852316 | G6PD | NM_000402.4(G6PD): c.1268G>A (p.Arg423His) | GATCCRCGTGCAGCCCAACGAGG | Anemia, nonspherocytic hemolytic, due to G6PD deficiency |
| 137852346 | G6PD | NM_000402.4(G6PD): c.896G>A (p.Cys299Tyr) | GATGCTGTRTCTGGTGGCCATGG | Anemia, nonspherocytic hemolytic, due to G6PD deficiency |
| 267606836 | G6PD | NM_000402.4(G6PD): c.634C>T (p.Arg212Trp) | CCTGCAGAGCTCTGACYGGCTGT | |
| 398123546 | G6PD | NM_000402.4(G6PD): c.1450C>T (p.Arg484Cys) | CCAGATGCACTTCGTGYGCAGGT | Favism, susceptibility to, Anemia, nonspherocytic hemolytic, due to G6PD deficiency, not provided |
| 137852330 | G6PD | NM_000402.4(G6PD): c.682C>T (p.Arg228Cys) | CCGTGAGGACCAGATCTACYGCA | |
| 137852334 | G6PD | NM_000402.4(G6PD): c.1249C>T (p.Arg417Cys) | CCACCAGCAGTGCAAGYGCAACG | Anemia, nonspherocytic hemolytic, due to G6PD deficiency |
| 137852345 | G6PD | NM_000402.4(G6PD): c.1172C>T (p.Ala391Val) | CCTGCGCTGCGGCAAGGYCCTGA | |
| 28937909 | GAA | NM_000152.3(GAA): c.1927G>A (p.Gly643Arg) | CTGGTCRGGGCCGACGTCTGCGG | GLYCOGEN STORAGE DISEASE II, ADULT FORM |
| 796051877 | GAA | NM_000152.3(GAA): c.1437G>A (p.Lys479=) | GAARGTAGGGCGAGGGTCCAGGG, GGAARGTAGGGCGAGGGTCCAGG | Glycogen storage disease, type II |
| 369532274 | GAA | NM_000152.3(GAA): c.2512C>T (p.Gln838Ter) | CCACAGAGTCCCGCYAGCAGCCC | Glycogen storage disease, type II, not provided |
| 121907942 | GAA | NM_000152.3(GAA): c.1634C>T (p.Pro545Leu) | CCCACCCTACGTGCYTGGTCAGC | GLYCOGEN STORAGE DISEASE II, ADULT FORM |
| 121907943 | GAA | NM_000152.3(GAA): c.2560C>T (p.Arg854Ter) | CCAAGGGTGGGGAGGCCYGAGGG | Glycogen storage disease, type II |
| 587777308 | GABRA1 | NM_000806.5(GABRA1): c.335G>A (p.Arg112Gln) | CCTCCRGTTAAATAACCTAATGG | Epileptic encephalopathy, early infantile, 19, not specified, not provided |
| 397514737 | GABRG2 | NM_000816.3(GABRG2): c.968G>A (p.Arg323Gln) | TGCCCRGAAATCGCTCCCCAAGG | Generalized epilepsy with febrile seizures plus 3, not provided |
| 121909673 | GABRG2 | NM_000816.3(GABRG2): c.245G>A (p.Arg82Gln) | AAACTTCRGCCTGATATAGGAGG | Epilepsy, childhood absence 2, Familial febrile seizures 8, not provided |
| 121909674 | GABRG2 | NM_198903.2(GABRG2): c.1312C>T (p.Gln438Ter) | CCCAAGATCAGCAACCATTYAAA, CCAAGATCAGCAACCATTYAAAT | Generalized epilepsy with febrile seizures plus 3 |
| 796052504 | GABRG2 | NM_000816.3(GABRG2): c.406C>T (p.Arg136Ter) | CCATTAAAGTCCTCYGATTGAAC | not provided |
| 28940882 | GALE | NM_000403.3(GALE): c.269G>A (p.Gly90Glu) | TTTGCGGRGCTCAAGGCCGTGGG, CTTTGCGGRGCTCAAGGCCGTGG | UDPglucose-4-epimerase deficiency |
| 28940885 | GALE | NM_000403.3(GALE): c.956G>A (p.Gly319Glu) | TGGRGTGGACAGCAGCCTTAGGG, CTGGRGTGGACAGCAGCCTTAGG | UDPglucose-4-epimerase deficiency, not provided |
| 137853860 | GALE | NM_000403.3(GALE): c.715C>T (p.Arg239Trp) | CCCTTCTCTGCAGGTGTCYGGGA, CCTTCTCTGCAGGTGTCYGGGAT | UDPglucose-4-epimerase deficiency |
| 111033608 | GALK1 | NM_000154.1(GALK1): c.1144C>T (p.Gln382Ter) | CCACCTTCTACCTCTCYAAGCA, CCTTCTACCTCTCYAAGCAGCC | Deficiency of galactokinase |
| 118204447 | GALNS | NM_000512.4(GALNS): c.178G>A (p.Asp60Asn) | TTGRACCGGATGGCTGCAGAAGG | Mucopolysaccharidosis, MPS-IV-A |
| 398123438 | GALNS | NM_000512.4(GALNS): c.463G>A (p.Gly155Arg) | CACRGATTTGATGAGTGGTTTGG, TGAAGCACRGATTTGATGAGTGG | Mucopolysaccharidosis, MPS-IV-A, not provided |
| 118204437 | GALNS | NM_000512.4(GALNS): c.1156C>T (p.Arg386Cys) | CCTATCTTCTATTACYGTGGCGA | Mucopolysaccharidosis, MPS-IV-A, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 367543255 | GALT | NM_000155.3(GALT): c.389G>A (p.Cys130Tyr) | CATGTRCTTCCACCCCTGGTCGG | Deficiency of UDPglucose-hexose-1-phosphate uridylyltransferase |
| 111033829 | GALT | NM_000155.3(GALT): c.98G>A (p.Arg33His) | TATCCRCTACAACCCGCTGCAGG | Deficiency of UDPglucose-hexose-1-phosphate uridylyltransferase |
| 111033675 | GALT | NM_000155.3(GALT): c.368G>A (p.Arg123Gln) | CTCRAGGAGTCTGGTAACTATGG | Deficiency of UDPglucose-hexose-1-phosphate uridylyltransferase |
| 111033694 | GALT | NM_000155.3(GALT): c.443G>A (p.Arg148Gln) | TCCRGGCTGTTGTTGATGCATGG | Deficiency of UDPglucose-hexose-1-phosphate uridylyltransferase |
| 111033704 | GALT | NM_000155.3(GALT): c.462G>A (p.Trp154Ter) | TGCATGRGCCTCAGTCACAGAGG | Deficiency of UDPglucose-hexose-1-phosphate uridylyltransferase |
| 111033723 | GALT | NM_000155.3(GALT): c.564+1G>A | CTGCCAGRTAAGGGTGTCAGGGG, ACTGCCAGRTAAGGGTGTCAGGG | Deficiency of UDPglucose-hexose-1-phosphate uridylyltransferase |
| 111033736 | GALT | NM_000155.3(GALT): c.607G>A (p.Glu203Lys) | GCGTGAGRAGCGATCTCAGCAGG | Deficiency of UDPglucose-hexose-1-phosphate uridylyltransferase |
| 111033747 | GALT | NM_000155.3(GALT): c.658G>A (p.Glu220Lys) | GCTAATGRAGTACAGCCGCCAGG | Deficiency of UDPglucose-hexose-1-phosphate uridylyltransferase |
| 111033784 | GALT | NM_000155.3(GALT): c.922G>A (p.Glu308Lys) | GATCARAGGCTGGGGCCAACTGG | Deficiency of UDPglucose-hexose-1-phosphate uridylyltransferase |
| 111033802 | GALT | NM_000155.3(GALT): c.983G>A (p.Arg328His) | TCCTGCRCTCTGCCACTGTCCGG | Deficiency of UDPglucose-hexose-1-phosphate uridylyltransferase |
| 367543268 | GALT | NM_000155.3(GALT): c.1060-1G>A | CCARGCTGCAGAGAGACTAAGGG, TCCARGCTGCAGAGAGACTAAGG | Deficiency of UDPglucose-hexose-1-phosphate uridylyltransferase |
| 367543266 | GALT | NM_000155.3(GALT): c.961C>T (p.His321Tyr) | CCATTGGCAGCTGCACGCTYATT | Deficiency of UDPglucose-hexose-1-phosphate uridylyltransferase |
| 111033739 | GALT | NM_000155.3(GALT): c.601C>T (p.Arg201Cys) | CCTGCCAGATATTGCCCAGYGTG, CCAGATATTGCCCAGYGTGAGGA | Deficiency of UDPglucose-hexose-1-phosphate uridylyltransferase |
| 111033774 | GALT | NM_000155.3(GALT): c.865C>T (p.Leu289Phe) | CCAAGTATGACAACYTCTTTGAG | Deficiency of UDPglucose-hexose-1-phosphate uridylyltransferase |
| 111033803 | GALT | NM_000155.3(GALT): c.986C>T (p.Ser329Phe) | CCCTCCGCTCCTGCGCTYTGCCA, CCTCCGCTCCTGCGCTYTGCCAC | Deficiency of UDPglucose-hexose-1-phosphate uridylyltransferase |
| 111033804 | GALT | NM_000155.3(GALT): c.989C>T (p.Ala330Val) | CCTCCGCTCCTGCGCTCTGYCAC, CCGCTCCTGCGCTCTGYCACTGT | Deficiency of UDPglucose-hexose-1-phosphate uridylyltransferase |
| 367543259 | GALT | NM_000155.3(GALT): c.542C>T (p.Ser181Phe) | CCATGATGGGCTGTTYTAACCCC | Deficiency of UDPglucose-hexose-1-phosphate uridylyltransferase |
| 368166217 | GALT | NM_000155.3(GALT): c.772C>T (p.Arg258Cys) | CCAGACACTGCTGCTGCCCYGTC | Deficiency of UDPglucose-hexose-1-phosphate uridylyltransferase |
| 111033649 | GALT | NM_000155.3(GALT): c.160C>T (p.Gln54Ter) | CCGCATGAAGCGGCCCTGGYAGG | Deficiency of UDPglucose-hexose-1-phosphate uridylyltransferase |
| 111033686 | GALT | NM_000155.3(GALT): c.413C>T (p.Thr138Met) | CCCCTGGTCGGATGTAAYGCTGC, CCCTGGTCGGATGTAAYGCTGCC, CCTGGTCGGATGTAAYGCTGCCA | Deficiency of UDPglucose-hexose-1-phosphate uridylyltransferase |
| 111033845 | GALT | NM_000155.3(GALT): c.770C>T (p.Pro257Leu) | CCAGACACTGCTGCTGCYCGTCG | Deficiency of UDPglucose-hexose-1-phosphate uridylyltransferase |
| 121909272 | GAMT | NM_000156.5(GAMT): c.506G>A (p.Cys169Tyr) | ACTRCAACCTCACCTCCTGGGGG, TACTRCAACCTCACCTCCTGGGG, CTACTRCAACCTCACCTCCTGGG, CCTACTRCAACCTCACCTCCTGG | Deficiency of guanidinoacetate methyltransferase |
| 80338735 | GAMT | NM_000156.5(GAMT): c.327G>A (p.Lys109=) | CAARGTGCCCCTCTGCCCGCAGG | Deficiency of guanidinoacetate methyltransferase, not provided |
| 119485089 | GAN | NM_022041.3(GAN): c.1447C>T (p.Gln483Ter) | CCGAAGTCGTGAGGACGCCYAGG | Giant axonal neuropathy |
| 104894809 | GATA1 | NM_002049.3(GATA1): c.647G>A (p.Arg216Gln) | CTGTGGCRGAGGGACAGGACAGG | Thrombocytopenia, platelet dysfunction, hemolysis, and imbalanced globin synthesis |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387907207 | GATA1 | NM_002049.3(GATA1): c.646C>T (p.Arg216Trp) | CCACTCCACTGTGGYGGAGGGAC | Thrombocytopenia, platelet dysfunction, hemolysis, and imbalanced globin synthesis |
| 387906630 | GATA2 | NM_001145661.1(GATA2): c.761C>T (p.Pro254Leu) | CCTACCCCTCCTATGTGCYGGCG, CCCCTCCTATGTGCYGGCGGCTG | Dendritic cell, monocyte, B lymphocyte, and natural killer lymphocyte deficiency |
| 387906632 | GATA2 | NM_001145661.1(GATA2): c.1009C>T (p.Arg337Ter) | CCACTCATCAAGCCCAAGYGAAG | Lymphedema, primary, with myelodysplasia |
| 104894162 | GATA3 | NM_001002295.1(GATA3): c.829C>T (p.Arg277Ter) | CCCCACTGTGGCGGYGAGATGGC | Barakat syndrome |
| 56208331 | GATA4 | NM_002052.4(GATA4): c.1273G>A (p.Asp425Asn) | GCAGRACTCTTGGAACAGCCTGG | Multiple congenital anomalies, Tetralogy of Fallot, Atrial septal defect 2 |
| 104894074 | GATA4 | NM_002052.4(GATA4): c.155C>T (p.Ser52Phe) | CCTCCGTGCTGGGCCTGTYCTAC, CCGTGCTGGGCCTGTYCTACCTC | Atrial septal defect 2 |
| 115372595 | GATA4 | NM_002052.4(GATA4): c.1037C>T (p.Ala346Val) | CCTCCCGCCAGCGGTGYTTCCAG | Atrioventricular septal defect 4 |
| 387906769 | GATA4 | NM_002052.4(GATA4): c.487C>T (p.Pro163Ser) | CCTACTCCAGCCCCTACYCGGCT | Tetralogy of Fallot, Ventricular septal defect 1, Atrioventricular septal defect 4 |
| 387906771 | GATA4 | NM_002052.4(GATA4): c.839C>T (p.Thr280Met) | CCAGACCACCACCACCAYGCTGT | Atrial septal defect 2 |
| 387906819 | GATA6 | NM_005257.5(GATA6): c.1367G>A (p.Arg456His) | TTATGGCRCAGAAACGCCGAGGG, CTTATGGCRCAGAAACGCCGAGG | Pancreatic agenesis and congenital heart disease |
| 80356772 | GBA | NM_000157.3(GBA): c.1505G>A (p.Arg502His) | AACCRGTGAGGGCAATGGTGAGG | Gaucher disease |
| 121908311 | GBA | NM_000157.3(GBA): c.1246G>A (p.Gly416Ser) | ATGTGGTCRGCTGGACCGACTGG | Gaucher disease, Subacute neuronopathic Gaucher disease, Gaucher disease, type 1 |
| 121908298 | GBA | NM_001005741.2(GBA): c.983C>T (p.Pro328Leu) | CCAACGCTTGCTGCTGCYCCACT | Gaucher disease, type 1 |
| 398123532 | GBA | NM_001005741.2(GBA): c.625C>T (p.Arg209Cys) | CCCTGCAGTTGGCCCAGYGTCCC, CCTGCAGTTGGCCCAGYGTCCCG | Gaucher disease, type 1, not provided |
| 398123015 | GBA2 | NM_020944.2(GBA2): c.2618G>A (p.Arg873His) | TCCRCTCACTGGCCTACATGCGG | |
| 398123013 | GBA2 | NM_020944.2(GBA2): c.700C>T (p.Arg234Ter) | CCATGCCCTCTATCCCYGAGCCT | |
| 80338673 | GBE1 | NM_000158.3(GBE1): c.1571G>A (p.Arg524Gln) | TGATTCRACTCATTACGCATGGG, ATGATTCRACTCATTACGCATG | Glycogen storage disease, type IV, GLYCOGEN STORAGE DISEASE IV, COMBINED HEPATIC AND MYOPATHIC |
| 786205862 | GCDH | NM_000159.3(GCDH): c.675G>A (p.Trp225Ter) | GTGTGRGCTCGGTGTGAAGATGG | Glutaric aciduria, type 1 |
| 147611168 | GCDH | NM_000159.3(GCDH): c.1240G>A (p.Glu414Lys) | ACACCTACRAAGGTAGGAGCTGG | Glutaric aciduria, type 1, not provided |
| 104894438 | GCH1 | NM_000161.2(GCH1): c.602G>A (p.Gly201Glu) | GCCTGCTGRAGTCGGGGTAGTGG | Dystonia 5, Dopa-responsive type |
| 104894443 | GCH1 | NM_000161.2(GCH1): c.633G>A (p.Met211Ile) | CACATRTGTATGGTAATGCGAGG | GTP cyclohydrolase I deficiency |
| 104894444 | GCH1 | NM_000161.2(GCH1): c.142C>T (p.Gln48Ter) | CCCGAGGCCAAGAGCGCGYAGCC, CCGAGGCCAAGAGCGCGYAGCCC | Dystonia 5, Dopa-responsive type |
| 193922289 | GCK | NM_000162.3(GCK): c.214G>A (p.Gly72Arg) | AGTCRGGGACTTCCTCTCCCTGG | Maturity-onset diabetes of the young, type 2 |
| 104894008 | GCK | NM_000162.3(GCK): c.781G>A (p.Gly261Arg) | CTTCRGGGACTCCGGCGAGCTGG | Maturity-onset diabetes of the young, type 2 |
| 104894012 | GCK | NM_000162.3(GCK): c.1363G>A (p.Val455Met) | CTCGGCGRTGGCCTGTAAGAAGG | Hyperinsulinemic hypoglycemia familial 3 |
| 104894016 | GCK | NM_000162.3(GCK): c.1132G>A (p.Ala378Thr) | GCGCRCTGCGCACATGTGCTCGG | Maturity-onset diabetes of the young, type 2 |
| 397514580 | GCK | NM_000162.3(GCK): c.1015G>A (p.Glu339Lys) | GGTGRAGAGGTGTGCGGAGGAGG, GCAGGTGRAGAGGTGTGCGGAGG | Maturity-onset diabetes of the young, type 2 |
| 587780347 | GCK | NM_000162.3(GCK): c.706G>A (p.Glu236Lys) | CATGRAGGAGATGCAGAATGTGG | Diabetes mellitus, gestational |
| 104894014 | GCK | NM_000162.3(GCK): c.1367C>T (p.Ala456Val) | CCCTGGTCTCGGCGGTGGYCTGT, CCTGGTCTCGGCGGTGGYCTGTA | Hyperinsulinemic hypoglycemia familial 3 |
| 80356655 | GCK | NM_000162.3(GCK): c.683C>T (p.Thr228Met) | CCGACCTCCACCCCAGGCAYGGG, CCTCCACCCCAGGCAYGGGCTGC | Permanent neonatal diabetes mellitus, Maturity-onset diabetes of the young, type 2 |
| 56141211 | GCNT2 | NM_001491.2(GCNT2): c.1043G>A (p.Gly348Glu) | ATGRAAACGGAGACTTAAAGTGG | I blood group system |
| 137853339 | GCNT2 | NM_145649.4(GCNT2): c.505G>A (p.Ala169Thr) | CCAGRCTGACCTGAACTGCCTGG | I blood group system |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397515432 | GDAP1 | NM_018972.2(GDAP1): c.980G>A (p.Gly327Asp) | GTTGRTTTGCTTGCAGGAGTGGG, GGTTGRTTTGCTTGCAGGAGTGG | Charcot-Marie-Tooth disease, recessive intermediate A |
| 387906946 | GDF3 | NM_020634.1(GDF3): c.820C>T (p.Arg274Trp) | CCAGCTATTCATTAACTTCYGGG | Microphthalmia, isolated, with coloboma 6 |
| 36119840 | GDNF | NM_000514.3(GDNF): c.277C>T (p.Arg93Trp) | TGCCRATTCCGCTCTCTTCTAGG | Congenital central hypoventilation, Hirschsprung disease 3, not specified |
| 58064122 | GFAP | NM_002055.4(GFAP): c.715C>T (p.Arg239Cys) | CCCTGAAAGAGATCYGCACGCAG | Alexander disease, not provided |
| 121908192 | GFER | NM_005262.2(GFER): c.581G>A (p.Arg194His) | ATGAGCRCTGGCGCGACGGCTGG | Myopathy, mitochondrial progressive, with congenital cataract, hearing loss, and developmental delay, not provided |
| 119470019 | GFM1 | NM_024996.5(GFM1): c.139C>T (p.Arg47Ter) | CCTAATGAAAAAATAYGAAATAT | Combined oxidative phosphorylation deficiency 1 |
| 121909678 | GGCX | NM_000821.6(GGCX): c.1672G>A (p.Gly558Arg) | GCTGCAGRGGGAAGTGACTGTGG | Pseudoxanthoma elasticum-like disorder with multiple coagulation factor deficiency |
| 121909682 | GGCX | NM_000821.6(GGCX): c.1427G>A (p.Arg476His) | TGACCRCTTCCAGCAGAGGTGGG, ATGACCRCTTCCAGCAGAGGTGG | Pseudoxanthoma elasticum-like disorder with multiple coagulation factor deficiency |
| 121909683 | GGCX | NM_000821.6(GGCX): c.763G>A (p.Val255Met) | TGCTGGTCRTGCACTGGGGTGGG | Pseudoxanthoma elasticum-like disorder with multiple coagulation factor deficiency |
| 121909680 | GGCX | NM_000821.6(GGCX): c.1120C>T (p.Gln374Ter) | CCTGCTCTACCTCCTGGAGYAGC | Pseudoxanthoma elasticum-like disorder with multiple coagulation factor deficiency |
| 121909684 | GGCX | NM_000821.6(GGCX): c.899C>T (p.Ser300Phe) | CCTAGGTATGTTCTYCTACGTCA | Pseudoxanthoma elasticum-like disorder with multiple coagulation factor deficiency |
| 387907000 | GIPC3 | NM_133261.2(GIPC3): c.903G>A (p.Trp301Ter) | AGTGTGRGCCGCCATCGGCGAGG | Deafness, autosomal recessive 15 |
| 387907002 | GIPC3 | NM_133261.2(GIPC3): c.565C>T (p.Arg189Cys) | CCCAGCCCTTCACCCTGYGCCTG, CCAGCCCTTCACCCTGYGCCTGG | Deafness, autosomal recessive 15 |
| 104893963 | GJA1 | NM_000165.4(GJA1): c.61G>A (p.Gly21Arg) | CAACTGCTRGAGGGAAGGTGTGG | Oculodentodigital dysplasia |
| 104893965 | GJA1 | NM_000165.4(GJA1): c.1127G>A (p.Arg376Gln) | CAGACCTCRGCCTGATGACCTGG | Hypoplastic left heart syndrome, Atrioventricular septal defect and common atrioventricular junction |
| 28931600 | GJA1 | NM_000165.4(GJA1): c.427G>A (p.Gly143Ser) | CATRGTAAGGTGAAAATGCGAGG | Syndactyly type 3 |
| 387906616 | GJA1 | NM_000165.4(GJA1): c.31C>T (p.Leu11Phe) | CCTTAGGCAAACTCYTTGACAAG | Oculodentodigital dysplasia |
| 397514703 | GJA3 | NM_021954.3(GJA3): c.5G>A (p.Gly2Asp) | ATGGRCGACTGGAGCTTTCTGGG, AATGGRCGACTGGAGCTTTCTGG | Zonular pulverulent cataract 3 |
| 398122937 | GJA3 | NM_021954.3(GJA3): c.427G>A (p.Gly143Arg) | GCATGGCCRGGGCGCTGCTGCGG | Zonular pulverulent cataract 3 |
| 121917825 | GJA3 | NM_021954.3(GJA3): c.560C>T (p.Pro187Leu) | CCGCTGGCCCTGCCYCAACACGG | Zonular pulverulent cataract 3 |
| 387906612 | GJA5 | NM_005266.6(GJA5): c.145C>T (p.Gln49Ter) | CCTGGGGGGATGAGYAGGCTGAT | Atrial fibrillation, familial, 11 |
| 397515627 | GJA8 | CNM_005267.4(GJA8): c.566>T (p.Pro189Leu) | CCGGTGGCCCTGCCYCAATGTGG | Cataract 1 |
| 786204123 | GJB1 | NM_000166.5(GJB1): c.425G>A (p.Arg142Gln) | GGTGTTCCRGCTGTTGTTTGAGG | Charcot-Marie-Tooth Neuropathy X |
| 104894814 | GJB1 | NM_001097642.2(GJB1): c.658C>T (p.Arg220Ter) | CCGGGCCTGTGCCCGCYGAGCCC | X-linked hereditary motor and sensory neuropathy |
| 104894824 | GJB1 | NM_000166.5(GJB1): c.164C>T (p.Thr55Ile) | CCTTCATCTGCAACAYACTCCAG | X-linked hereditary motor and sensory neuropathy |
| 587777876 | GJB1 | NM_000166.5(GJB1): c.77C>T (p.Ser26Leu) | CCGAGTATGGCTCYTGGTCATCT | X-linked hereditary motor and sensory neuropathy |
| 587777879 | GJB1 | NM_000166.5(GJB1): c.790C>T (p.Arg264Cys) | CCCTGAAAGACATACTGYGCCGC, CCTGAAAGACATACTGYGCCGCA | X-linked hereditary motor and sensory neuropathy |
| 587781246 | GJB1 | NM_000166.5(GJB1): c.688C>T (p.Arg230Cys) | CCGCTCCAATCCACCTTCCYGCA, CCAATCCACCTTCCYGCAAGGGC | Charcot-Marie-Tooth disease |
| 116840819 | GJB1 | NM_000166.5(GJB1): c.223C>T (p.Arg75Trp) | CCCCATCTCCCATGTGYGGCTGT, CCATCTCCCATGTGYGGCTGTGG | X-linked hereditary motor and sensory neuropathy |
| 587783645 | GJB2 | NM_004004.5(GJB2): c.158G>A (p.Cys53Tyr) | GTCRCAACACCCTGCAGCCAGG | Hearing impairment |
| 80338940 | GJB2 | NM_004004.5(GJB2): c.-23+1G>A | GCAGRTGAGCCCGCCGGCCCCGG | Deafness, autosomal recessive 1A, Hearing impairment |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894402 | GJB2 | NM_004004.5(GJB2): c.223C>T (p.Arg75Trp) | CCCCATCTCCCACATCYGGCTAT, CCCATCTCCCACATCYGGCTATG, CCATCTCCCACATCYGGCTATGG | Deafness, autosomal dominant 3a |
| 76434661 | GJB2 | NM_004004.5(GJB2): c.416G>A (p.Ser139Asn) | CCCGGAAGAAGATGYTGCTTGTG | Deafness, autosomal recessive 1A, Hearing impairment |
| 72555392 | GLB1 | NM_000404.2(GLB1): c.176G>A (p.Arg59His) | CCCRTGTGCCCCGCTTCTACTGG | Mucopolysaccharidosis, MPS-IV-B, Infantile GM1 gangliosidosis, Juvenile GM>1<gangliosidosis, Gangliosidosis GM1 type 3, GM1-GANGLIOSIDOSIS, TYPE I, WITH CARDIAC INVOLVEMENT, not provided |
| 398123351 | GLB1 | NM_000404.2(GLB1): c.1769G>A (p.Arg590His) | GGCCRCTATTGGCCAGCCCGGGG, TGGCCRCTATTGGCCAGCCCGGG, TTGGCCRCTATTGGCCAGCCCGG | Mucopolysaccharidosis, MPS-IV-B, Infantile GM1 gangliosidosis, Juvenile GM>1<gangliosidosis, Gangliosidosis GM1 type 3, not provided |
| 398123353 | GLB1 | NM_000404.2(GLB1): c.397-1G>A | ACTARGGAGGATTACCTGCTTGG | Mucopolysaccharidosis, MPS-IV-B, Infantile GM1 gangliosidosis, Juvenile GM>1<gangliosidosis, Gangliosidosis GM1 type 3, not provided |
| 72555359 | GLB1 | NM_000404.2(GLB1): c.1369C>T (p.Arg457Ter) | CCCCCAGGGAGTCCTTGAGYGAA, CCCCAGGGAGTCCTTGAGYGAAA, CCCAGGGAGTCCTTGAGYGAAAC, CCAGGGAGTCCTTGAGYGAAACA | Infantile GM1 gangliosidosis |
| 72555366 | GLB1 | NM_000404.2(GLB1): c.622C>T (p.Arg208Cys) | CCTGCAGAAGCGCTTTYGCCACC | Mucopolysaccharidosis, MPS-IV-B, Infantile GM1 gangliosidosis, Juvenile GM>1<gangliosidosis, Gangliosidosis GM1 type 3, not provided |
| 72555370 | GLB1 | NM_000404.2(GLB1): c.202C>T (p.Arg68Trp) | CCGCTTCTACTGGAAGGACYGGC | Juvenile GM>1<gangliosidosis |
| 121964980 | GLDC | NM_000170.2(GLDC): c.2216G>A (p.Arg739His) | TCTGTCRCCCTGGAGACTTCGGG, ATCTGTCRCCCTGGAGACTTCGG | Non-ketotic hyperglycinemia |
| 121964977 | GLDC | NM_000170.2(GLDC): c.2405C>T (p.Ala802Val) | CCTGTGGGAACCGTCAGTGYGGC | Non-ketotic hyperglycinemia |
| 121917707 | GLI2 | NM_005270.4(GLI2): c.1323G>A (p.Trp441Ter) | CCACTGRGAAGACTGCACCAAGG | Holoprosencephaly 9 |
| 116840748 | GLI3 | NM_000168.5(GLI3): c.2110C>T (p.Gln704Ter) | CCCCAACAGACATCTYAGCCAAG, CCCAACAGACATCTYAGCCAAGC | Pallister-Hall syndrome |
| 116840770 | GLI3 | NM_000168.5(GLI3): c.3481C>T (p.Gln1161Ter) | CCGACCTGCCCATTYAGTGGAAC | Pallister-Hall syndrome |
| 281864919 | GLRA1 | NM_000171.3(GLRA1): c.1259G>A (p.Arg420His) | ATCCCRCATTGGCTTCCCCATGG | Hyperekplexia hereditary |
| 116474260 | GLRA1 | NM_001146040.1(GLRA1): c.1132G>A (p.Gly378Ser) | CCTGTAGACAGGCTGGGCYCATC | Hyperekplexia hereditary |
| 121909749 | GLRB | NM_000824.4(GLRB): c.752G>A (p.Gly251Asp) | GAAAGRCTACTACACATGCGTGG | Hyperekplexia 2 |
| 121909736 | GLUD1 | NM_005271.3(GLUD1): c.953G>A (p.Arg318Lys) | ATGARATATTTACATCGTTTTGG | Hyperinsulinism-hyperammonemia syndrome |
| 397509422 | GMPPB | NM_013334.3(GMPPB): c.1081G>A (p.Asp361Asn) | CCGTTGAGGTAGAGCTCATYATT | Limb-girdle muscular dystrophy-dystroglycanopathy, type C14, Congenital muscular dystrophy-dystroglycanopathy with brain and eye anomalies, type A14 |
| 397509423 | GMPPB | NM_013334.3(GMPPB): c.220C>T (p.Arg74Ter) | CCTTCCAGCTGGGAATCYGAATC | Congenital muscular dystrophy-dystroglycanopathy with brain and eye anomalies, type A14 |
| 397509424 | GMPPB | NM_013334.3(GMPPB): c.64C>T (p.Pro22Ser) | CCGCTGACGCTGAGCACCYCGAA | Limb-girdle muscular dystrophy-dystroglycanopathy, type C14 |
| 397509425 | GMPPB | NM_021971.2(GMPPB): c.553C>T (p.Arg185Cys) | CCCTGCAGTGCTGCAGYGCATCC, CCTGCAGTGCTGCAGYGCATCA | Limb-girdle muscular dystrophy-dystroglycanopathy, type C14, Congenital muscular dystrophy-dystroglycanopathy with brain and eye anomalies, type A14, Congenital muscular dystrophy-dystroglycanopathy |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| | | | | with mental retardation, type B14 |
| 202160208 | GMPPB | NM_013334.3(GMPPB): c.860G>A (p.Arg287Gln) | CCGCAGCACCGTGCACCGCYGGA | Congenital muscular dystrophy-dystroglycanopathy with mental retardation, type B14 |
| 137853227 | GNAI2 | NM_002070.3(GNAI2): c.536G>A (p.Arg179His) | GGACCCRCGTAAAGACCACGGG, CGGACCCRCGTAAAGACCACGGG, ACGGACCCRCGTAAAGACCACGG | Granulosa cell tumor of the ovary |
| 398122923 | GNAL | NM_001142339.2(GNAL): c.409G>A (p.Val137Met) | TGACCATRTGAAAAAACTTTGGG, TTGACCATRTGAAAAAACTTTGG | Dystonia 25 |
| 397514698 | GNAQ | NM_002072.4(GNAQ): c.548G>A (p.Arg183Gln) | GAGTTCRAGTCCCCACCACAGG, AGAGTTCRAGTCCCCACCACAGG | Sturge-Weber syndrome, Capillary malformations, congenital, 1 |
| 121913495 | GNAS | NM_000516.5(GNAS): c.602G>A (p.Arg201His) | CGCTGCCDTGTCCTGACTTCTGG | McCune-Albright syndrome, Somatotroph adenoma, Sex cord-stromal tumor, Cushing syndrome |
| 137854539 | GNAS | NM_001077488.3(GNAS): c.347C>T (p.Pro116Leu) | CCATGAGCAACCTGGTGCYCCCC | Pseudohypoparathyroidism type 1A, Pseudopseudohypoparathyroidism |
| 121908625 | GNE | NM_001128227.2(GNE): c.1820G>A (p.Gly607Glu) | GATGRGCCTGATTGTTCCTGTGG | Inclusion body myopathy 2 |
| 62541771 | GNE | NM_001128227.2(GNE): c.1985C>T (p.Ala662Val) | GTTTCRCAGCTTGGATGAGATGG | Inclusion body myopathy 2, Nonaka myopathy |
| 121434440 | GNPAT | NM_014236.3(GNPAT): c.631C>T (p.Arg211Cys) | CCTTTTTCATGCGGYGTACCTTT | Rhizomelic chondrodysplasia punctata type 2 |
| 137852885 | GNPTG | NM_032520.4(GNPTG): c.316G>A (p.Gly106Ser) | TCCTCRGGTGAGTGGGGCCGGGG, ATCCTCRGGTGAGTGGGGCCGGG, GATCCTCRGGTGAGTGGGGCCGG | Mucolipidosis III Gamma |
| 193302848 | GNPTG | NM_032520.4(GNPTG): c.196C>T (p.Arg66Ter) | CCCGTGCATCTCTTCYGACTCTC, CCGTGCATCTCTTCYGACTCTCG | Mucolipidosis III Gamma |
| 193302854 | GNPTG | NM_032520.4(GNPTG): c.610-1G>T | CCTGCATCCTCCACCTTCAYGGC | Mucolipidosis III Gamma |
| 104893842 | GNRHR | NM_000406.2(GNRHR): c.416G>A (p.Arg139His) | ACCRCTCCCTGGCTATCACGAGG | |
| 104893847 | GNRHR | NM_000406.2(GNRHR): c.959C>T (p.Pro320Leu) | CCCATGCTTTGATCYACTTATCT | |
| 267606849 | GP1BA | NM_000173.6(GP1BA): c.1620G>A (p.Trp540Ter) | CTGRCTGCTCTTTGCCTCTGTGG | Bernard-Soulier syndrome, type A1 |
| 121908063 | GP1BA | NM_000173.6(GP1BA): c.217C>T (p.Leu73Phe) | CCTGATGCCTTACACTCGCYTCA | Bernard-Soulier syndrome, type A2, autosomal dominant |
| 137853582 | GPI | NM_000175.3(GPI): c.475G>A (p.Gly159Ser) | TTGGCRGCTCCGACCTGGTGAGG | Hemolytic anemia, nonspherocytic, due to glucose phosphate isomerase deficiency |
| 137853585 | GPI | NM_000175.3(GPI): c.1615G>A (p.Asp539Asn) | CTCACRACGCTTCTACCAATGGG, TCTCACRACGCTTCTACCAATGG | Hemolytic anemia, nonspherocytic, due to glucose phosphate isomerase deficiency |
| 61754634 | GPI | NM_000175.3(GPI): c.671C>T (p.Thr224Met) | CCATCACGAATGCAGAGAYGGCG | Hemolytic anemia, nonspherocytic, due to glucose phosphate isomerase deficiency |
| 267606852 | GPI | NM_000175.3(GPI): c.14C>T (p.Thr5Ile) | CCCGCCATGGCCGCTCTCAYCCG, CCGCCATGGCCGCTCTCAYCCGG, CCATGGCCGCTCTCAYCCGGGAC | Hemolytic anemia, nonspherocytic, due to glucose phosphate isomerase deficiency |
| 58933950 | GPR143 | NM_000273.2(GPR143): c.455G>A (p.Ser152Asn) | CCATTTCCTCGGTGAATACYTCA | Ocular albinism, type I, not provided |
| 387907138 | GPR179 | NM_001004334.3(GPR179): c.598C>T (p.Arg200Ter) | CCCCTGCCCTGAAGAAGYGAGTG, CCCTGCCCTGAAGAAGYGAGTGT, CCTGCCCTGAAGAAGYGAGTGTT | Congenital stationary night blindness, type 1E |
| 267606854 | GPSM2 | NM_013296.4(GPSM2): c.379C>T (p.Arg127Ter) | CCATAGTTTGTTGTCAGYGACAC | Chudley-McCullough syndrome |
| 769967246 | GPX4 | NM_001039848.2(GPX4): c.381C>A (p.Tyr127Ter) | CCTGCACGCCCGATAYGCTGAGT | Spondylometaphyseal dysplasia Sedaghatian type |
| 180177312 | GRHPR | NM_012203.1(GRHPR): c.478G>A (p.Gly160Arg) | ATCATCRGGCTGGGGCGCATAGG | Primary hyperoxaluria, type II |
| 180177314 | GRHPR | NM_012203.1(GRHPR): c.494G>A (p.Gly165Asp) | CTCTAGRCCAGGCCATTGCTCGG | Primary hyperoxaluria, type II |
| 180177322 | GRHPR | NM_012203.1(GRHPR): c.904C>T (p.Arg302Cys) | CCACCCACAGAACCYGCAACACC | Primary hyperoxaluria, type II |
| 137852350 | GRIA3 | NM_007325.4(GRIA3): c.2497G>A (p.Gly833Arg) | ACTTGTCRGAGGTCTGGGGCTGG | Mental retardation, X-linked, syndromic, wu type |
| 397518470 | GRIN2A | NM_000833.4(GRIN2A): c.1553G>A (p.Arg518His) | TGAGGAACRTTCTGAAGTGGTGG | Focal epilepsy with speech disorder with or without mental retardation |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 796052571 | GRIN2B | NM_000834.3(GRIN2B): 1858G>A (p.Val620Met) | TACCTRTGCAGAACCCAAAGGGG, GTACCTRTGCAGAACCCAAAGGG, CGTACCTRTGCAGAACCCAAAGG | not provided |
| 397514556 | GRIN2B | NM_000834.3(GRIN2B): c.1658C>T (p.Pro553Leu) | CCCTTCCTCAGAGCYATTCAGCG | Mental retardation, autosomal dominant 6 |
| 63750331 | GRN | NM_002087.3(GRN): c.3G>A (p.Met1Ile) | CATRTGGACCCTGGTGAGCTGGG, CCATRTGGACCCTGGTGAGCTGG | Frontotemporal dementia, ubiquitin-positive, not provided |
| 606231221 | GRN | NM_002087.3(GRN): c.835+1G>A | GCACACAGRTACCAGAGGCAGGG | Frontotemporal dementia, ubiquitin-positive |
| 63750077 | GRN | NM_002087.3(GRN): c.373C>T (p.Gln125Ter) | CCGTGGGTGCCATCYAGTGCCCT | Frontotemporal dementia, ubiquitin-positive, not provided |
| 63751294 | GRN | NM_002087.3(GRN): c.1477C>T (p.Arg493Ter) | CCTGCAACGTGAAGGCTYGATCC | Frontotemporal dementia, ubiquitin-positive, not provided |
| 193026789 | GRN | NM_002087.3(GRN): c.1212C>A (p.Cys404Ter) | CCACCAGCACTGCTGYCCCCAGG | Frontotemporal dementia |
| 587777289 | GSC | NM_173849.2(GSC): c.400C>T (p.Gln134Ter) | CAGCATCTRGTGCGGTACCGGGG | Short stature, auditory canal atresia, mandibular hypoplasia, skeletal abnormalities |
| 121909307 | GSS | NM_000178.2(GSS): c.491G>A (p.Arg164Gln) | TGTGCACCRGTGGGTCCCTGGG | Gluthathione synthetase deficiency |
| 121909124 | GUCA1B | NM_002098.5(GUCA1B): c.469G>A (p.Gly157Arg) | GAGAATRGAGATGGTAAGAGGGG, TGAGAATRGAGATGGTAAGAGGG, ATGAGAATRGAGATGGTAAGAGG | Retinitis pigmentosa 48, not provided |
| 61750173 | GUCY2D | NM_000180.3(GUCY2D): c.2513G>A (p.Arg838His) | CCGGGAGCRCACGGAGGAGCTGG | Cone-rod dystrophy 6, not provided |
| 121918179 | GUSB | NM_000181.3(GUSB): c.1521G>A (p.Trp507Ter) | ACTCTTGRTATCACGACTACGGG, TACTCTTGRTATCACGACTACGG | Mucopolysaccharidosis type VII |
| 398123234 | GUSB | NM_000181.3(GUSB): c.1084G>A (p.Asp362Asn) | GGGCTTCRACTGGCCGCTGCTGG | Mucopolysaccharidosis type VII, not provided |
| 377519272 | GUSB | NM_000181.3(GUSB): c.1616_1653del38 (p.Ser539Argfs*8) | CCATACTCRCTCTGAATAATGGG | Mucopolysaccharidosis type VII |
| 587779400 | GUSB | NM_000181.3(GUSB): c.530C>T (p.Thr177Ile) | CCATCAACAACACACTCAYCCCC | Mucopolysaccharidosis type VII |
| 121918181 | GUSB | NM_000181.3(GUSB): c.526C>T (p.Leu176Phe) | CCATCAACAACACAYTCACCCCC | Mucopolysaccharidosis type VII, not provided |
| 121434584 | GYS1 | NM_002103.4(GYS1): c.1384C>T (p.Arg462Ter) | CCTGACCACCATCCGCYGAATCG | Glycogen storage disease 0, muscle |
| 121918419 | GYS2 | NM_021957.3(GYS2): c.736C>T (p.Arg246Ter) | CCACCGGTACTGCATGGAGYGAG, CCGGTACTGCATGGAGYGAGCTT | Hypoglycemia with deficiency of glycogen synthetase in the liver |
| 137853101 | HADH | NM_005327.4(HADH): c.118G>A (p.Ala40Thr) | GATGGGCRCCGGCATTGCCCAGG | Deficiency of 3-hydroxyacyl-CoA dehydrogenase |
| 137853103 | HADH | NM_005327.4(HADH): c.773C>T (p.Pro258Leu) | CCGGTTACCCCATGGGCCYATTT | Hyperinsulinemic hypoglycemia, familial, 4 |
| 121913134 | HADHB | NM_000183.2(HADHB): c.1331G>A (p.Arg444Lys) | AACARATTACGGAAAGAAGGAGG, GCCAACARATTACGGAAAGAAGG | Mitochondrial trifunctional protein deficiency |
| 104894695 | HAMP | NM_021175.3(HAMP): c.166C>T (p.Arg56Ter) | CCATGTTCCAGAGGYGAAGGAGG, CCATGTTCCAGAGGYGAAGGAGG | Hemochromatosis type 2B |
| 74315322 | HAX1 | NM_006118.3(HAX1): c.568C>T (p.Gln190Ter) | CCAGATCTTGATTCCYAGGTTTC | Severe congenital neutropenia 3, autosomal recessive |
| 41417548 | HBA2 | NM_000517.4(HBA2): c.314G>A (p.Cys105Tyr) | CCACTRCCTGCTGGTGACCCTGG | Hemoglobin H disease, nondeletional |
| 63750783 | HBB | NM_000518.4(HBB): c.47H>A (p.Trp16Ter) | CCTGTGGGCAAGGTGAACGTGGA | beta |
| 34999973 | HBB | NM_000518.4(HBB): c.-140C>T | CCTCACCCTGTGGAGCCAYACCC | beta Thalassemia |
| 34883338 | HBB | NM_000518.4(HBB): c.-50-92C>T | CCTCACCCTGTGGAGCYACACCC | |
| 35378915 | HBG1 | NM_000559.2(HBG1): c.-170G>A | CTTRACCAATAGCCTTGACAAGG | Fetal hemoglobin quantitative trait locus 1 |
| 35983258 | HBG1 | NM_000559.2(HBG1): c.-53-196C>T | CCTCTTGGGGGCCCCTTCYCCAC | Fetal hemoglobin quantitative trait locus 1 |
| 281860601 | HBG1 | NM_000559.2(HBG1): c.-167C>T | CCAGCCTTGCCTTGACYAATAGC | Fetal hemoglobin quantitative trait locus 1 |
| 34474104 | HBG2 | NM_000184.2(HBG2): c.190C>T (p.His64Tyr) | CCCCAAAGTCAAGGCAYATGGCA, CCCAAAGTCAAGGCAYATGGCAA, CCAAAGTCAAGGCAYATGGCAAG | Cyanosis, transient neonatal |
| 35103459 | HBG2 | NM_000184.2(HBG2): c.277C>T (p.His93Tyr) | CCCAGCTGAGTGAACTGYACTGT, CCAGCTGAGTGAACTGYACTGTG | Cyanosis, transient neonatal |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587776864 | HBG2 | NM_000184.2(HBG2): c.202G>A (p.Val68Met) | CCCAAGGAAGTCAGCAYCTTCTT, CCAAGGAAGTCAGCAYCTTCTTG | Cyanosis, transient neonatal |
| 193929392 | HCCS | NM_005333.4(HCCS): c.475G>A (p.Glu159Lys) | GAATAACRAGCAGGCTTGGAAGG | Microphthalmia, syndromic, 7 |
| 318240758 | HCFC1 | NM_005334.2(HCFC1): c.674G>A (p.Ser225Asn) | GATGARTGGCTGCAGGCTGGGGG, GGATGARTGGCTGCAGGCTGGGG, GGGATGARTGGCTGCAGGCTGGG, CGGGATGARTGGCTGCAGGCTGG | Mental retardation 3, X-linked, not provided |
| 397515486 | HCFC1 | NM_005334.2(HCFC1): c.218C>T (p.Ala73Val) | CCAGTGGTTCATCCCAGYCGTGA | Mental retardation 3, X-linked |
| 398122909 | HDAC8 | NM_018486.2(HDAC8): c.958G>A (p.Gly320Arg) | ACTTGACCRGGGTCATCCTAGGG | Cornelia de Lange syndrome 5 |
| 387907052 | HEPACAM | NM_152722.4(HEPACAM): c.292C>T (p.Arg98Cys) | CCTGACTATCGAGACYGTATCCG | Megalencephalic leukoencephalopathy with subcortical cysts 2a |
| 104893742 | HESX1 | NM_003865.2(HESX1): c.445G>A (p.Glu149Lys) | TCTAGAGRAAGACAGAATCCAGG | Growth hormone deficiency with pituitary anomalies |
| 121907954 | HEXA | NM_000520.4(HEXA): c.805G>A (p.Gly269Ser) | ACCARGTAAGAATGATGTCTGGG, GACCARGTAAGAATGATGTCTGG | Tay-Sachs disease, Gm2-gangliosidosis, adult |
| 121907957 | HEXA | NM_000520.4(HEXA): c.509G>A (p.Arg170Gln) | TCCTCACCRGGGCTTGCTGTTGG | Tay-Sachs disease |
| 121907980 | HEXA | NM_000520.4(HEXA): c.805+1G>A | ACCAGRTAAGAATGATGTCTGGG, GACCAGRTAAGAATGATGTCTGG | |
| 1800429 | HEXA | NM_000520.4(HEXA): c.598G>A (p.Val200Met) | GAACRTGTTCCACTGGCATCTGG | Tay-Sachs disease, B1 variant |
| 121907966 | HEXA | NM_000520.4(HEXA): c.1495C>T (p.Arg499Cys) | CCTGACATTTGCCTATGAAYGTT | Tay-Sachs disease, Gm2-gangliosidosis, adult-onset |
| 121907972 | HEXA | NM_000520.4(HEXA): c.508C>T (p.Arg170Trp) | CCCCGCTTTCCTCACYGGGGCTT, CCCGCTTTCCTCACYGGGGCTTG | Tay-Sachs disease |
| 76173977 | HEXA | NM_000520.4(HEXA): c.1073+1G>A | CCCTCCTTCCTTCCTCAYGTCTG, CCTCCTTCCTTCCTCAYGTCTGG | Tay-Sachs disease, not provided |
| 770932296 | HEXA | NM_000520.4(HEXA): c.806-7G>A | CCAGGGATACCTAAGCYAAGAGA | Tay-Sachs disease |
| 121907983 | HEXB | NM_000521.3(HEXB): c.1514G>A (p.Arg505Gln) | AGGCCTCRGGCAAGTGCTGTTGG | Sandhoff disease, adult type |
| 121907986 | HEXB | NM_000521.3(HEXB): c.850C>T (p.Arg284Ter) | CCAGATTACGAGGAATTYGAGTC | Sandhoff disease, Sandhoff disease, infantile |
| 1800562 | HFE | NM_000410.3(HFE): c.845G>A (p.Cys282Tyr) | ACGTRCCAGGTGGAGCACCCAGG | Hemochromatosis type 1, Microvascular complications of diabetes 7, Transferrin serum level quantitative trait locus 2, not specified, not provided |
| 587777269 | HFM1 | NM_001017975.4(HFM1): c.2206G>A (p.Gly736Ser) | CCAAGTCAAAGTAACAAACYATA | Premature ovarian failure 9 |
| 397515347 | HGD | NM_000187.3(HGD): c.16-1G>A | TACARTACATTTCTGGATTTGGG, CTACARTACATTTCTGGATTTGG | Alkaptonuria |
| 28942100 | HGD | NM_000187.3(HGD):688 c.688C>T (p.Pro230Ser) | CCTCGTGATTTCTTGATAYCCAT | Alkaptonuria |
| 398124544 | HGSNAT | NM_152419.2(HGSNAT): c.1250+1G>A | CTACRTAAGCGAACCCCTGGGGG, CCTACRTAAGCGAACCCCTGGGG, CCCTACRTAAGCGAACCCCTGGG, GCCCTACRTAAGCGAACCCCTGG | not provided |
| 112029032 | HGSNAT | NM_152419.2(HGSNAT): c.1843G>A (p.Ala615Thr) | CATCGTCRCCACTGCCCTCTGGG, ACATCGTCRCCACTGCCCTCTGG | Mucopolysaccharidosis, MPS-III-C, RETINITIS PIGMENTOSA 73 |
| 121908286 | HGSNAT | NM_152419.2(HGSNAT): c.1553C>T (p.Ser518Phe) | CCATTACAGGGGCTCATTTYTGT | Mucopolysaccharidosis, MPS-III-C |
| 397514493 | HINT1 | NM_005340.6(HINT1): c.278G>A (p.Gly93Asp) | GAATAAGGRTTATCGAATGGTGG | Gamstorp-Wohlfart syndrome |
| 397514492 | HINT1 | NM_005340.6(HINT1): c.184C>T (p.Gln62Ter) | CCCAAGAAACATATATCCYAGAT, CCAAGAAACATATATCCYAGATT | Gamstorp-Wohlfart syndrome |
| 146448211 | HLCS | NM_000411.6(HLCS): c.1993C>T (p.Arg665Ter) | AGTATCRGTAATAAGGGGAAGG | not provided |
| 119103231 | HLCS | NM_000411.6(HLCS): c.1648G>A (p.Val550Met) | TGGCTGTCRTGGAAGCAGTGAGG | Holocarboxylase synthetase deficiency, not provided |
| 119103229 | HLCS | NM_000411.6(HLCS): c.1522C>T (p.Arg508Trp) | CCTGTGTTCCAGGAYGGGGAGGG | Holocarboxylase synthetase deficiency |
| 118204096 | HMBS | NM_000190.3(HMBS): c.518G>A (p.Arg173Gln) | CAACACCCRGCTTCGGAAGCTGG | Acute intermittent porphyria |
| 118204100 | HMBS | NM_000190.3(HMBS): c.593G>A (p.Trp198Ter) | TGGGCTRGCACAACCGGGTGGGG, ATGGGCTRGCACAACCGGGTGGG, CATGGGCTRGCACAACCGGGTGG | Acute intermittent porphyria |
| 118204103 | HMBS | NM_000190.3(HMBS): c.77G>A (p.Arg26His) | GGTACCCRCAAGAGCCAGGTGGG, GGGTACCCRCAAGAGCCAGGTGG | Acute intermittent porphyria |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 118204104 | HMBS | NM_000190.3(HMBS): c.91G>A (p.Ala31Thr) | GCAGCTTRCTCGCATACAGACGG | Acute intermittent porphyria |
| 118204110 | HMBS | NM_000190.3(HMBS): c.667G>A (p.Glu223Lys) | GGGCGTGRAAGTGCGAGCCAAGG | Acute intermittent porphyria |
| 118204112 | HMBS | NM_000190.3(HMBS): c.748G>A (p.Glu250Lys) | TCGCTRAAAGGGCCTTCCTGAGG | Acute intermittent porphyria |
| 118204113 | HMBS | NM_000190.3(HMBS): c.754G>A (p.Ala252Thr) | AAGGRCCTTCCTGAGGCACCTGG | Acute intermittent porphyria |
| 118204116 | HMBS | NM_000190.3(HMBS): c.647G>A (p.Gly216Asp) | TGGRCCAGGTACACTTGACCAGG | Acute intermittent porphyria |
| 118204094 | HMBS | NM_000190.3(HMBS): c.346C>T (p.Arg116Trp) | CCTTCCCTCCTCCCCCAGGYGGG, CCCTCCTCCCCCAGGYGGGAAAA, CCTCCTCCCCCAGGYGGGAAAAC | Acute intermittent porphyria |
| 118204101 | HMBS | NM_000190.3(HMBS): c.499C>T (p.Arg167Trp) | CCTTAGCAACTCTCCACAGYGGG | Acute intermittent porphyria |
| 28937320 | HMGCS2 | NM_001166107.1(HMGCS2): c.160G>A (p.Val54Met) | GGACRTGGGCATCCTGGCCCTGG | mitochondrial 3-hydroxy-3-methylglutaryl-CoA synthase deficiency |
| 137852639 | HMGCS2 | NM_001166107.1(HMGCS2): c.1373G>A (p.Arg458His) | AGCATCRCCGAAAGTATGCCCGG | mitochondrial 3-hydroxy-3-methylglutaryl-CoA synthase deficiency |
| 137853238 | HNF1A | NM_000545.6(HNF1A): c.815G>A (p.Arg272His) | GGCRCAAAGAAGAAGCCTTCCGG | Diabetes mellitus, insulin-dependent, 20 |
| 137853241 | HNF1A | NM_000545.6(HNF1A): c.1859C>T (p.Thr620Ile) | CCACAGCGTCATCGAGAYCTTCA | Maturity-onset diabetes of the young, type 3 |
| 137853243 | HNF1A | NM_000545.6(HNF1A): c.335C>T (p.Pro112Leu) | CCCTCTCCCAGGGAGGACCYGTG, CCTCTCCCAGGGAGGACCYGTGG | Maturity-onset diabetes of the young, type 3 |
| 121918675 | HNF1B | NM_000458.3(HNF1B): c.494G>A (p.Arg165His) | AGCRTGCCGCTCTGTACACCTGG | Familial hypoplastic, glomerulocystic kidney |
| 137853336 | HNF4A | NM_000457.4(HNF4A): c.406C>T (p.Arg136Trp) | CCAGAATGAGCGGGACYGGATCA | Maturity-onset diabetes of the young, type 1 |
| 777046879 | HOGA1 | NM_138413.3(HOGA1): c.973G>A (p.Gly325Ser) | CAACRGCTGGCTCTGAGGGCAGG, CCAGCAACRGCTGGCTCTGAGGG | Primary hyperoxaluria, type III |
| 764396564 | HOGA1 | NM_138413.3(HOGA1): c.134C>T (p.Pro45Leu) | CCCCCCTGTGACCACCCYCTTCA, CCCCCTGTGACCACCCYCTTCAC, CCCTGTGACCACCCYCTTCACTG | Primary hyperoxaluria, type III |
| 104894019 | HOXA13 | NM_000522.4(HOXA13): c.1107G>A (p.Trp369Ter) | AATCTGRTTCCAGAACAGGAGGG, CAATCTGRTTCCAGAACAGGAGG | Hand foot uterus syndrome |
| 550921485 | HPCA | NM_002143.2(HPCA): c.568G>A (p.Ala190Thr) | CAGCRCCTCCCAGTTCTGAGAGG | Dystonia 2, torsion, autosomal recessive |
| 398123240 | HPRT1 | NM_000194.2(HPRT1): c.384+1G>A | GAAAGRTATGTATCTTGAAAGGG, GGAAAGRTATGTATCTTGAAAGG | not provided |
| 398123241 | HPRT1 | NM_000194.2(HPRT1): c.486-1G>A | TTAACARCTTGCTGGTGAAAAGG | not provided |
| 137852506 | HPRT1 | NM_000194.2(HPRT1): c.193C>T (p.Leu65Phe) | CCATCACATTGTAGCCYTCTGTG | Partial hypoxanthine-guanine phosphoribosyltransferase deficiency |
| 281865089 | HPS1 | NM_000195.4(HPS1): c.1749G>A (p.Trp583Ter) | CCAGCTGGATCAGAGAYCAGACC | Hermansky-Pudlak syndrome 1 |
| 121908316 | HPS3 | NM_032383.4(HPS3): c.1189C>T (p.Arg397Trp) | CCTGCAGTGTTTCACTGTGYGGT | Hermansky-Pudlak syndrome 3 |
| 119471023 | HPS4 | NM_022081.5(HPS4): c.649C>T (p.Arg217Ter) | CCAAGGTCCTGCTTCACYGAACA | Hermansky-Pudlak syndrome 4 |
| 281865107 | HPS6 | NM_024747.5(HPS6): c.223C>T (p.Gln75Ter) | GGAGGGCTRGCCGGCCGGCCAGG | Hermansky-Pudlak syndrome 6 |
| 281865109 | HPS6 | NM_024747.5(HPS6): c.815C>T (p.Thr272Ile) | GCCCAGRTGTGTACAGCCAGTGG | Hermansky-Pudlak syndrome 6 |
| 281865112 | HPS6 | NM_024747.5(HPS6): c.1234C>T (p.Gln412Ter) | CCGCCGCTRGTAGTACCCGCAGG | Hermansky-Pudlak syndrome 6 |
| 121434451 | HR | NM_005144.4(HR): c.3034G>A (p.Asp1012Asn) | GGCCRACCTGGTCAGCATCCTGG | Alopecia universalis congenita |
| 121917780 | HSD11B2 | NM_000196.3(HSD11B2): c.622C>T (p.Arg208Cys) | CCTCCTGCCCCTGCTGYGCAGCT | Apparent mineralocorticoid excess |
| 28935475 | HSD17B10 | NM_001037811.2 (HSD17B10):c.388C>T (p.Arg130Cys) | CCTTCAATGTGATCYGCCTGGTG | 2-methyl-3-hydroxybutyric aciduria |
| 119481078 | HSD17B3 | NM_000197.1(HSD17B3): c.166G>A (p.Ala56Thr) | CTGGARCAGGCGATGGAATTGGG, ACTGGARCAGGCGATGGAATTGG | Testosterone 17-beta-dehydrogenase deficiency |
| 28939085 | HSD17B3 | NM_000197.1(HSD17B3): c.695C>T (p.Ser232Leu) | CCCCATATGCTGTCTYGACTGCA, CCCATATGCTGTCTYGACTGCAA | Testosterone 17-beta-dehydrogenase deficiency |
| 80358216 | HSD3B2 | NM_001166120.1(HSD3B2): c.512G>A (p.Trp171Ter) | AATGGGTRGAATCTAAAAAATGG | 3 beta-Hydroxysteroid dehydrogenase deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28937569 | HSPB1 | NM_001540.3(HSPB1): c.545C>T (p.Pro182Leu) | CCAACGAGATCACCATCCYAGTC | Distal hereditary motor neuronopathy type 2B |
| 104894020 | HSPB1 | NM_001540.3(HSPB1): c.544C>T (p.Pro182Ser) | CCAACGAGATCACCATCYCAGTC | Distal hereditary motor neuronopathy type 2B |
| 29001571 | HSPB1 | NM_001540.3(HSPB1): c.379C>T (p.Arg127Trp) | CCGGCAAGCACGAGGAGYGGCAG | Charcot-Marie-Tooth disease type 2F, Distal hereditary motor neuronopathy type 2B |
| 137853248 | HSPG2 | NM_005529.6(HSPG2): c.4595G>A (p.Cys1532Tyr) | CGCTRCCCGCCAGGCTACATCGG | Schwartz Jampel syndrome type 1 |
| 587776445 | HTRA1 | NM_002775.4(HTRA1): c.821G>A (p.Arg274Gln) | GCTGCRGCCGGGAGAGTTCGTGG | Cerebral autosomal recessive arteriopathy with subcortical infarcts and leukoencephalopathy |
| 113993969 | HTRA1 | NM_002775.4(HTRA1): c.889G>A (p.Val297Met) | ATCRTGAGCACCACCCAGCGAGG | Cerebral autosomal recessive arteriopathy with subcortical infarcts and leukoencephalopathy |
| 113993971 | HTRA1 | NM_002775.4(HTRA1): c.1108C>T (p.Arg370Ter) | CCTCACGGAGTCCCATGACYGAC | Cerebral autosomal recessive arteriopathy with subcortical infarcts and leukoencephalopathy |
| 104893743 | HYAL1 | NM_153281.1(HYAL1): c.802G>A (p.Glu268Lys) | TGTGGCCRAGGCATTCCGTGTGG | Deficiency of hyaluronoglucosaminidase |
| 373436822 | IARS2 | NM_018060.3(IARS2): c.1821G>A (p.Trp607Ter) | TCATGRTCTTATGTTCTTCCAGG | Leigh disease, not provided |
| 118203918 | ICK | NM_016513.4(ICK): c.815G>A (p.Arg272Gln) | GAAACRACCAACAGCTAGTCAGG | Endocrine-cerebroosteodysplasia |
| 121913500 | IDH1 | NM_001282386.1(IDH1): c.395G>A (p.Arg132His) | CATAGGTCRTCATGCTTATGGGG | |
| 121913502 | IDH2 | NM_002168.3(IDH2): c.419G>A (p.Arg140Gln) | CTATCCRGAACATCCTGGGGGGG, ACTATCCRGAACATCCTGGGGGG, AACTATCCRGAACATCCTGGGGG | D-2-hydroxyglutaric aciduria 2 |
| 104894853 | IDS | NM_000202.6(IDS): c.998C>T (p.Ser333Leu) | CCATCATTGCATTTACCTYGGAT | Mucopolysaccharidosis, MPS-II, not provided |
| 199422231 | IDS | NM_000202.6(IDS): c.1402C>T (p.Arg468Trp) | CCTATAGCCAGTATCCCYGGCCT | Mucopolysaccharidosis, MPS-II |
| 121965019 | IDUA | NM_000203.4(IDUA): c.1205G>A (p.Trp402Ter) | GCTCTRGGCCGAAGTGTCGCAGG | Hurler syndrome, not provided |
| 121965030 | IDUA | NM_000203.4(IDUA): c.898G>A (p.Ala300Thr) | GACGAGRCGGACCCGCTGGTGGG, CGACGAGRCGGACCCGCTGGTGG | |
| 121965032 | IDUA | NM_000203.4(IDUA): c.1091C>T (p.Thr364Met) | CCCCTTCGCGCAGCGCAYGCTCA, CCCTTCGCGCAGCGCAYGCTCAC, CCTTCGCGCAGCGCAYGCTCACC | Mucopolysaccharidosis, MPS-I-H/S |
| 786201032 | IFITM5 | NM_001025295.2(IFITM5): c.119C>T (p.Ser40Leu) | CCACTTGATCTGGTYGGTGTTCA | Osteogenesis imperfecta type 5 |
| 431905521 | IF1140 | NM_014714.3(IFT140): c.874G>A (p.Val292Met) | TCTCRTGATGGCCGTCGGGGAGG, CCTTCTCRTGATGGCCGTCGGGG, GCCTTCTCRTGATGGCCGTCGGG | Renal dysplasia, retinal pigmentary dystrophy, cerebellar ataxia and skeletal dysplasia |
| 794727473 | IF1140 | NM_014714.3(IFT140): c.3991C>T (p.Gln1331Ter) | CCAGGAGACCAGGCTGGCGYAGC | Renal dysplasia, retinal pigmentary dystrophy, cerebellar ataxia and skeletal dysplasia |
| 199826737 | IFT140 | NM_014714.3(IFT140): c.1565G>A (p.Gly522Glu) | CCAAGAAGCAGGGATTCYCCTCA | |
| 201188361 | IF1140 | NM_014714.3(IFT140): c.634G>A (p.Gly212Arg) | CCAAAGTTCCTCACYGTCCATCA | Renal dysplasia, retinal pigmentary dystrophy, cerebellar ataxia and skeletal dysplasia |
| 145541911 | IFT172 | NM_015662.2(IFT172): c.886C>T (p.Arg296Trp) | GCCATCCCRCTTCCAGGCCAAGG | |
| 587777546 | IF127 | NM_001177701.2(IFT27): c.299G>A (p.Cys100Tyr) | CCAGCCACTTGCTGYAGTTGTTG | Bardet-Biedl syndrome 19 |
| 137852667 | IGHMBP2 | NM_002180.2(IGHMBP2): c.1738G>A (p.Val580Ile) | TTCRTCAGATCCAACAGGAAAGG, TGTCCTTCRTCAGATCCAACAGG | Werdnig-Hoffmann disease, Charcot-Marie-Tooth disease |
| 74315491 | IGLL1 | NM_020070.3(IGLL1): c.64C>T (p.Gln22Ter) | CCAGGCCCAACCTCAGGYAGCG | Agammaglobulinemia 2, autosomal recessive |
| 121917853 | IHH | NM_002181.3(IHH): c.391G>A (p.Glu131Lys) | ACCRAGGGCTGGGACGAGGACGG, GGTGACCRAGGGCTGGGACGAGG | Brachydactyly type A1 |
| 121917855 | IHH | NM_002181.3(IHH): c.298G>A (p.Asp100Asn) | CGCCRACCGCCTCATGACCCAGG | Brachydactyly type A1 |
| 267606873 | IHH | NM_002181.3(IHH): c.383G>A (p.Arg128Gln) | GCTGCRGGTGACCGAGGGCTGGG, AGCTGCRGGTGACCGAGGGCTGG | Brachydactyly type A1 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121917861 | IHH | NM_002181.3(IHH): c.461C>T (p.Thr154Ile) | CCGCGCGGTGGACATCAYCACAT | Brachydactyly type A1 |
| 121917856 | IHH | NM_002181.3(IHH): c.137C>T (p.Pro46Leu) | CCGCCACGCAAACTCGTGCYGCT, CCACGCAAACTCGTGCYGCTCGC | Acrocapitofemoral dysplasia |
| 200296680 | IKBKB | NM_001556.2(IKBKB): c.814C>T (p.Arg272Ter) | CCACAGTGTCCTGGCTGAGYGAC | Immunodeficiency 15 |
| 137853329 | IKBKG | NM_003639.4(IKBKG): c.1207C>T (p.Gln403Ter) | CCCAAGTGCCAGTATYAGGCCCC, CCAAGTGCCAGTATYAGGCCCCT | Hypohidrotic ectodermal dysplasia with immune deficiency |
| 149491038 | IL10RA | NM_001558.3(IL10RA): c.784C>T (p.Arg262Cys) | CCTCCAGCTGTATGTGCGGYGCC, CCAGCTGTATGTGCGGYGCCGAA | |
| 137853580 | IL10RA | NM_001558.3(IL10RA): c.251C>T (p.Thr84Ile) | CCCTGTCCTATGACCTTAYCGCA, CCTGTCCTATGACCTTAYCGCAG | |
| 387906787 | IL11RA | NM_001142784.2(IL11RA): c.475C>T (p.Gln159Ter) | CCTAGGAGCTGATAGCYAGAGGT | Craniosynostosis and dental anomalies |
| 121434492 | IL12RB1 | NM_005535.2(IL12RB1): c.94C>T (p.Gln32Ter) | CCAGTGAGTGCTGTTTTYAGGAC | Immunodeficiency 30 |
| 748486078 | IL17F | NM_052872.3(IL17F): c.284C>T (p.Ser95Leu) | CTTCCRAGGGGTACCGGTTGGGG, ACTTCCRAGGGGTACCGGTTGGG, AACTTCCRAGGGGTACCGGTTGG | Candidiasis, familial, 6 |
| 387906913 | IL17RA | NM_014339.6(IL17RA): c.850C>T (p.Gln284Ter) | CCCTCTCTGCCCGCAGATCYAGC, CCTCTCTGCCCGCAGATCYAGCC | Candidiasis, familial, 5 |
| 122461161 | IL1RAPL1 | NM_014271.3(IL1RAPL1): c.1460G>A (p.Trp487Ter) | GGGCTRGAGCATCTTTGAGCTGG | Mental retardation 21, X-linked |
| 137852508 | IL2RG | NM_000206.2(IL2RG): c.865C>T (p.Arg289Ter) | CCCTGTCAGGACGATGCCCYGAA, CCTGTCAGGACGATGCCCYGAAT | X-linked severe combined immunodeficiency |
| 104893894 | IL7R | NM_002185.3(IL7R): c.394C>T (p.Pro132Ser) | CCAGTTAAACCTGAGGCTYCTTT | Severe combined immunodeficiency, autosomal recessive, T cell-negative, B cell-positive, NK cell-positive |
| 121912551 | IMPDH1 | NM_000883.3(IMPDH1): c.1057G>A (p.Val353Ile) | GGGCRTCGACGTCATAGTCTTGG | Retinitis pigmentosa 10 |
| 121912553 | IMPDH1 | NM_000883.3(IMPDH1): c.568C>T (p.Arg190Trp) | CCAGGCCAACGAGGTGYGGAAGG | Leber congenital amaurosis 11 |
| 267607183 | INF2 | NM_022489.3(INF2): c.653G>A (p.Arg218Gln) | CAGCTGCRGAACGAGTTTATCGG | Focal segmental glomerulosclerosis 5 |
| 121918129 | INPP5E | NM_019892.4(INPP5E): c.1304G>A (p.Arg435Gln) | AGCRGCTGCTGGACTACACCAGG | Familial aplasia of the vermis, Joubert syndrome 1 |
| 104894698 | INSL3 | NM_005543.3(INSL3): c.304C>T (p.Arg102Cys) | CCAGACCTCTCACCATCACYGCC, CCTCTCACCATCACYGCCACCAC | Cryptorchidism, unilateral or bilateral |
| 121913139 | INSR | NM_000208.2(INSR): c.3481G>A (p.Ala1161Thr) | CCTGRCAGCGAGAAACTGCATGG | Insulin resistance, Insulin-resistant diabetes mellitus AND acanthosis nigricans |
| 121913146 | INSR | NM_000208.2(INSR): c.479G>A (p.Trp160Ter) | TATCGACTRGTCCCGTATCCTGG | Insulin-resistant diabetes mellitus AND acanthosis nigricans |
| 121913150 | INSR | NM_000208.2(INSR): c.3572G>A (p.Arg1191Gln) | TACTACCRGAAAGGGGCAAGGG, TTACTACCRGAAAGGGGCAAGG | Diabetes mellitus type 2 |
| 121913156 | INSR | NM_000208.2(INSR): c.3602G>A (p.Arg1201Gln) | CCCTGTACRGTGGATGGCACCGG | Insulin-resistant diabetes mellitus AND acanthosis nigricans, Hyperinsulinemic hypoglycemia familial 5 |
| 1799816 | INSR | NM_000208.2(INSR): c.3034G>A (p.Val1012Met) | GTACRTGCCGGACGAGTGGGAGG, TGTGTACRTGCCGGACGAGTGGG, CTGTGTACRTGCCGGACGAGTG | Diabetes mellitus type 2, not specified |
| 755549444 | INVS | NM_014425.3(INVS): c.2509C>T (p.Gln837Ter) | CCAAGAAACAAAGTGACAYAAGC | Infantile nephronophthisis |
| 121918244 | IQCB1 | NM_001023570.2(IQCB1): c.1381C>T (p.Arg461Ter) | CCGAGTTGAACTGAAGAAAYGAG | Senior-Loken syndrome 5, not provided |
| 727503968 | IQCB1 | NM_001023570.2(IQCB1): c.1090C>T (p.Arg364Ter) | CCATGAGACTTTCCYGAGAATTG | Senior-Loken syndrome 5, not provided |
| 587777261 | IQSEC2 | NM_001111125.2(IQSEC2): c.2563C>T (p.Arg855Ter) | GATGAGTCRCTCCACTTTCTGGG | Mental retardation, X-linked, nonspecific |
| 267607186 | IQSEC2 | NM_001111125.2(IQSEC2): c.2587C>T (p.Arg863Trp) | CCTCCTGCCCTGCAGCCAGYGGT, CCTGCCCTGCAGCCAGYGGTACT | Mental retardation, X-linked, nonspecific, not provided |
| 267607188 | IQSEC2 | NM_001111125.2(IQSEC2): c.1075C>T (p.Arg359Cys) | CCATCCAGACAGCCTTCYGCCAG | Mental retardation, X-linked, nonspecific |
| 377584435 | IRAK4 | NM_016123.3(IRAK4): c.34C>T (p.Arg12Cys) | CCATCAACATATGTGYGCTGCCT | IRAK4 deficiency |
| 121434228 | IRF6 | NM_006147.3(IRF6): c.1137G>A (p.Trp379Ter) | ATGRCCAGATGGGAAACCATTGG | Van der Woude syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397515434 | IRF6 | NM_006147.3(IRF6): c.145C>T (p.Gln49Ter) | CCACCCGGCATAGCCCTYAACAA, CCCGGCATAGCCCYAACAAGAA | Van der Woude syndrome |
| 28942093 | IRF6 | NM_006147.3(IRF6): c.5C>T (p.Ala2Val) | CCCCCCAGATCATGGYCCTCCA, CCCCCCAGATCATGGYCCTCCAC, CCCCCAGATCATGGYCCTCCACC | Van der Woude syndrome |
| 121434230 | IRF6 | NM_006147.3(IRF6): c.1186C>T (p.Pro396Ser) | CCTGAACAGGTCATTYCAGTAGT | Van der Woude syndrome |
| 387906968 | IRF6 | NM_006147.3(IRF6): c.1271C>T (p.Ser424Leu) | CCGCCTGCAGATCTYAACCCCAG | Popliteal pterygium syndrome |
| 786201005 | ISG15 | NM_005101.3(ISG15): c.163C>T (p.Gln55Ter) | CCCGAGCGGTGTGGCGCTGYAGG, CCGAGCGGTGTGGCGCTGYAGGA | Immunodeficiency 38 |
| 368593151 | ISPD | NM_001101426.3(ISPD): c.802C>T (p.Arg268Ter) | CTCRTTTGTAGGTCACCTAAAGG | Congenital muscular dystrophy-dystroglycanopathy with brain and eye anomalies, type A7 |
| 137852907 | ITGA2B | NM_000419.3(ITGA2B): c.818G>A (p.Gly273Asp) | GGCCGTGGRCGAGTTCGACGGGG | Glanzmann thrombasthenia |
| 137852906 | ITGA2B | NM_000419.3(ITGA2B): c.1750C>T (p.Arg584Ter) | CCACCATGGCCTTCCTTYGAGTA, CCATGGCCTTCCTTYGAGTACGC | Glanzmann thrombasthenia |
| 200402328 | ITGA7 | NM_002206.2(ITGA7): c.2357+1G>A | CCGGCCCCGCCTGGCTTAYGTGG, CCCCGCCTGGCTTAYGTGGCCAA | Congenital muscular dystrophy |
| 374664941 | ITGA8 | NM_003638.2(ITGA8): c.1219G>A (p.Gly407Arg) | CCTGCAAAAGGCACTCYGATGGC | Renal adysplasia |
| 9983887 | ITGB2 | NM_000211.4(ITGB2): c.329-6C>T | GCCRGTGGGACAGAACAAAAGG | Leukocyte adhesion deficiency type 1 |
| 137852616 | ITGB2 | NM_000211.4(ITGB2): c.850G>A (p.Gly284Ser) | CGACRGCCGCTGTCACCTGGAGG, CAACGACRGCCGCTGTCACCTGG | Leukocyte adhesion deficiency |
| 121918449 | ITGB3 | NM_000212.2(ITGB3): c.1199G>A (p.Cys400Tyr) | TGCCACCTRCCTCAACAATGAGG | Glanzmann thrombasthenia |
| 121912466 | ITGB4 | NM_000213.3(ITGB4): c.2792G>A (p.Gly931Asp) | CCGGGRCATGGTGGAGTTCCAGG | Adult junctional epidermolysis bullosa |
| 80338755 | ITGB4 | NM_000213.3(ITGB4): c.182G>A (p.Cys61Tyr) | CCGGCGCTRCAACACCCAGGCGG | Epidermolysis bullosa with pyloric atresia |
| 121912462 | ITGB4 | NM_000213.3(ITGB4): c.1660C>T (p.Arg554Ter) | CCCTCTCTGCAGACYGAGGACGC | Epidermolysis bullosa with pyloric atresia |
| 121908191 | ITK | NM_005546.3(ITK): c.1003C>T (p.Arg335Trp) | CCTGGTGACTCGACTCYGGTATC | Lymphoproliferative syndrome 1 |
| 763471771 | IVD | NM_002225.3(IVD): c.793+1G>A | GATTCCTGRTAAGTAGCACCGGG | Isovaleryl-CoA dehydrogenase deficiency |
| 28940889 | IVD | NM_002225.3(IVD): c.941C>T (p.Ala314Val) | CCTGCACGTGAGGGAAGYCTTTG | Isovaleryl-CoA dehydrogenase deficiency, not provided |
| 28939668 | JAG1 | NM_000214.2(JAG1): c.821G>A (p.Gly274Asp) | ACGRCATCTGTAATGAGCCCTGG | Tetralogy of Fallot |
| 121918350 | JAG1 | NM_000214.2(JAG1): c.550C>T (p.Arg184Cys) | CCACTTTGAGTATCAGATCYGCG | Alagille syndrome 1 |
| 587777727 | JAGN1 | NM_032492.3(JAGN1): c.3G>A (p.MetIle) | GGCACAATRGCGTCTCGAGCAGG | Severe congenital neutropenia, Severe congenital neutropenia 6, autosomal recessive |
| 137852626 | JAK3 | NM_000215.3(JAK3): c.1333C>T (p.Arg445Ter) | CCTTCTGGTTGGCCTCAGCYGAC | Severe combined immunodeficiency, autosomal recessive, T cell-negative, B cell-positive, NK cell-negative |
| 796052595 | KANSL1 | NM_001193466.1(KANSL1): c.2203+1G>A | CCARTAAGTGTCAGGGAGCCGGG, GCCARTAAGTGTCAGGGAGCCGG | not provided |
| 397514746 | KARS | NM_001130089.1(KARS): c.1129G>A (p.Asp377Asn) | TCACRATCTCATGGAAATCACGG | Deafness, autosomal recessive 89 |
| 730880257 | KATNB1 | NM_005886.2(KATNB1): c.1604C>T (p.Ser535Leu) | CCATCAACGACCTGTYGGTGGTG | Lissencephaly 6, with microcephaly |
| 786205232 | KCNA2 | NM_004974.3(KCNA2): c.890G>A (p.Arg297Gln) | TCCRGTTGGTAAGAGTCTTTAGG | EPILEPTIC ENCEPHALOPATHY, EARLY INFANTILE, 32 |
| 121908593 | KCNA5 | NM_002234.3(KCNA5): c.1828G>A (p.Glu610Lys) | CCGGRAAACAGATTTGTGAAAGG | Atrial fibrillation, familial, 7 |
| 1805128 | KCNE1 | NM_000219.5(KCNE1): c.253G>A (p.Asp85Asn) | GTCCRATGCCTGGCAAGAGAAGG | Long QT syndrome, Long QT syndrome 5, acquired, susceptibility to, Long QT syndrome 2/5, not specified, not provided |
| 199473360 | KCNE1 | NM_000219.5(KCNE1): c.247G>A (p.Glu83Lys) | TCTACATCRAGTCCGATGCCTGG | Congenital long QT syndrome |
| 199473644 | KCNE1 | NM_000219.5(KCNE1): c.163G>A (p.Gly55Ser) | TTCTTCRGCTTCTTCACCCTGGG, ATTCTTCRGCTTCTTCACCCTGG | Congenital long QT syndrome, not specified |
| 79654911 | KCNE1 | NM_000219.5(KCNE1): c.200G>A (p.Arg67His) | CCAGCTTCTTGGAGYGGATGTAG | Long QT syndrome, Congenital long QT syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 74315446 | KCNE1 | NM_000219.5(KCNE1): c.221C>T (p.Ser74Leu) | CCAAGAAGCTGGAGCACTYGAAC | Long QT syndrome 5, Congenital long QT syndrome |
| 28933384 | KCNE1 | NM_000219.5(KCNE1): c.20C>T (p.Thr7Ile) | CCTGTCTAACACCAYAGCGGTGA | Jervell and Lange-Nielsen syndrome 2, Congenital long QT syndrome |
| 199473367 | KCNE2 | NM_172201.1(KCNE2): c.347C>T (p.Ala116Val) | CCATGAGAACATTGGTGYGGCTG | Acquired long QT syndrome |
| 199473648 | KCNE2 | NM_172201.1(KCNE2): c.29C>T (p.Thr10Met) | CCAATTTCACACAGAYGCTGGAA | Long QT syndrome, Congenital long QT syndrome, Cardiac arrhythmia |
| 730882174 | KCNH1 | NM_002238.3(KCNH1): c.1042G>A (p.Gly348Arg) | TGAATATRGAGCTGCTGTGCTGG | Zimmermann-Laband syndrome |
| 794728397 | KCNH2 | NM_000238.3(KCNH2): c.2770G>A (p.Gly924Arg) | CCGGCCGRGGGGCCGTGGGGGG, GCCGGCCGRGGGGGCCGTGGGGG | Cardiac arrhythmia |
| 794728401 | KCNH2 | NM_000238.3(KCNH2): c.3002G>A (p.Trp1001Ter) | AGCTTCTRGGGGACAGTCGGGG, CAGCTTCTRGGGGGACAGTCGGG | Cardiac arrhythmia |
| 794728478 | KCNH2 | NM_000238.3(KCNH2): c.1129-1G>A | CGGGTGCARGTCCTGTCCCTGGG | Cardiac arrhythmia |
| 794728487 | KCNH2 | NM_000238.3(KCNH2): c.1945+1G>A | GCTRTGAGTGTGCCCAGGGGCGG, TTGGCTRTGAGTGTGCCCAGGGG, ATTGGCTRTGAGTGTGCCCAGGG, CATTGGCTRTGAGTGTGCCCAGG | Cardiac arrhythmia |
| 141401803 | KCNH2 | NM_000238.3(KCNH2): c.2860C>T (p.Arg954Cys) | GGCRGAGGGGGCTGGAGCTGCGG | Sudden infant death syndrome, Cardiac arrhythmia |
| 199472880 | KCNH2 | NM_000238.3(KCNH2): c.865G>A (p.Glu289Lys) | CATCRAGGCCATGCGCGCCGGGG, ACATCRAGGCCATGCGCGCCGGG, GACATCRAGGCCATGCGCGCCGG | Congenital long QT syndrome |
| 199472937 | KCNH2 | NM_000238.3(KCNH2): c.1811G>A (p.Gly604Asp) | CCTGGGCGDCCCCTCCATCAAGG | Congenital long QT syndrome |
| 199473019 | KCNH2 | NM_000238.3(KCNH2): c.3014G>A (p.Arg1005Gln) | CAGTCRGGGCCGCCAGTACCAGG | Congenital long QT syndrome |
| 199473022 | KCNH2 | NM_000238.3(KCNH2): c.3107G>A (p.Gly1036Asp) | CCCGGGRCGACGTGGAGAGCAGG | Congenital long QT syndrome, Cardiac arrhythmia |
| 199473432 | KCNH2 | NM_000238.3(KCNH2): c.2660G>A (p.Arg887His) | AGCRCAAGTTGTCCTTCCGCAGG | Long QT syndrome, Congenital long QT syndrome |
| 199473540 | KCNH2 | NM_000238.3(KCNH2): c.2810G>A (p.Ser937Asn) | CTCCARCCCTGAGAGCAGTGAGG | Congenital long QT syndrome, Cardiac arrhythmia |
| 199473669 | KCNH2 | NM_000238.3(KCNH2): c.2707G>A (p.Gly903Arg) | CCARGGGAGGTGTCGGCCTTGGG, GCCARGGGAGGTGTCGGCCTTGG | Congenital long QT syndrome, Cardiac arrhythmia |
| 199473670 | KCNH2 | NM_000238.3(KCNH2): c.2759G>A (p.Arg920Gln) | GTAGCCRGGGCCGGCCGGGGGGG, AGTAGCCRGGGCCGGCCGGGGGG, GAGTAGCCRGGGCCGGCCGGGGG | Congenital long QT syndrome |
| 121912509 | KCNH2 | NM_000238.3(KCNH2): c.3003G>A (p.Trp1001Ter) | AGCTTCTGRGGGGACAGTCGGGG | Long QT syndrome 2, Cardiac arrhythmia |
| 138498207 | KCNH2 | NM_000238.3(KCNH2): c.2371C>T (p.Arg791Trp) | GTCGCCCCRCAGGATCTCGATGG | Long QT syndrome, Congenital long QT syndrome, Cardiac arrhythmia |
| 770047651 | KCNH2 | NM_000238.3(KCNH2): c.1128G>A (p.Gln376=) | CCGGCCGCTGGGCGCCTACYTGG, CCGCTGGGCGCCTACYTGGGTGA | Long QT syndrome, Cardiac arrhythmia |
| 794728381 | KCNH2 | NM_000238.3(KCNH2): c.2026C>T (p.Gln676Ter) | CCCGCTACCACACAYAGATGCTG | Cardiac arrhythmia |
| 794728403 | KCNH2 | NM_000238.3(KCNH2): c.3040C>T (p.Arg1014Ter) | CCAGTACCAGGAGCTCCCTYGAT | Cardiac arrhythmia |
| 794728364 | KCNH2 | NM_000238.3(KCNH2): c.1096C>T (p.Arg366Ter) | CCTAAGATAAAGGAGYGAACCCA | Cardiac arrhythmia |
| 794728481 | KCNH2 | NM_000238.3(KCNH2): c.1684C>T (p.His562Tyr) | CCTTTGCGCTCATCGCGYACTGG | Cardiac arrhythmia |
| 199472885 | KCNH2 | NM_000238.3(KCNH2): c.934C>T (p.Arg312Cys) | CCATGCACCCACTGYGCAGCGGC | Long QT syndrome, Congenital long QT syndrome, Cardiac arrhythmia |
| 199472901 | KCNH2 | NM_000238.3(KCNH2): c.1307C>T (p.Thr436Met) | CCTTCCTGCTGAAGGAGAYGGAA, CCTGCTGAAGGAGAYGGAAGAAG | Congenital long QT syndrome |
| 199472910 | KCNH2 | NM_000238.3(KCNH2): c.1474C>T (p.His492Tyr) | CCCCGGCCGCATCGCCGTCYACT, CCCGGCCGCATCGCCGTCYACTA, CCGGCCGCATCGCCGTCYACTAC | Congenital long QT syndrome |
| 199472984 | KCNH2 | NM_000238.3(KCNH2): c.2086C>T (p.Arg696Cys) | CCCCAATCCCCTGCGCCAGYGCC, CCCCAATCCCCTGCGCCAGYGCCT, CCAATCCCCTGCGCCAGYGCCTC | Congenital long QT syndrome |
| 199473021 | KCNH2 | NM_000238.3(KCNH2): c.3097C>T (p.Arg1033Trp) | CCTCTCCAGCCCGGTCGGYGGC, CCAGCCCGGGTCGGYGGCCCCGG | Congenital long QT syndrome |
| 199473035 | KCNH2 | NM_000238.3(KCNH2): c.3457C>T (p.His1153Tyr) | CCCAGCCCCTGCACAGAYACGGC, CCAGCCCCTGCACAGAYACGCT | Congenital long QT syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121912504 | KCNH2 | NM_000238.3(KCNH2): c.1682C>T (p.Ala561Val) | CCTTTGCGCTCATCGYGCACTGG | Long QT syndrome 2, Congenital long QT syndrome, Cardiac arrhythmia |
| 121912508 | KCNH2 | NM_000238.3(KCNH2): c.1744C>T (p.Arg582Cys) | CCACACATGGACTCAYGCATCGG | Long QT syndrome 2, Congenital long QT syndrome, Cardiac arrhythmia |
| 794728382 | KCNH2 | NM_000238.3(KCNH2): c.2104C>T (p.Gln702Ter) | CCTCGAGGAGTACTTCYAGCACG | Cardiac arrhythmia |
| 150988911 | KCNH2 | NM_000238.3(KCNH2): c.343G>A (p.Val115Met) | CCCCATCCTCGTTCTTCAYGGGC, CCCATCCTCGTTCTTCAYGGGCA, CCATCCTCGTTCTTCAYGGGCAC | Long QT syndrome 2, Congenital long QT syndrome |
| 77331749 | KCNH2 | NM_000238.3(KCNH2): c.2738C>T (p.Ala913Val) | CCTTGGGGCCGGGCCGGGYGGGG | Long QT syndrome 2, Congenital long QT syndrome, Long QT syndrome 2/9, digenic, Cardiac arrhythmia |
| 104894253 | KCNJ1 | NM_153767.3(KCNJ1): c.535G>A (p.Ala179Thr) | AACRCAGTGATCAGCAAACGGGG, GAACRCAGTGATCAGCAAACGGG, AGAACRCAGTGATCAGCAAACGG | Bartter syndrome antenatal type 2 |
| 137853067 | KCNJ10 | NM_002241.4(KCNJ10): c.595C>T (p.Arg199Ter) | CCCTGCCTCATGATCYGAGTTGC, CCTGCCTCATGATCYGAGTTGCC | SeSAME syndrome |
| 137853071 | KCNJ10 | NM_002241.4(KCNJ10): c.889C>T (p.Arg297Cys) | CCACCTGTCAGGTGYGCACTTCC | SeSAME syndrome |
| 137853074 | KCNJ10 | NM_002241.4(KCNJ10): c.1042C>T (p.Arg348Cys) | CCTCCGTGACAGCACTGTAYGCT, CCGTGACAGCACTGTAYGCTACG | Enlarged vestibular aqueduct syndrome |
| 80356615 | KCNJ11 | NM_000525.3(KCNJ11): c.158G>A (p.Gly53Asp) | GGAGCAGGRCCGCTTCCTGCAGG | Permanent neonatal diabetes mellitus, Diabetes mellitus, permanent neonatal, with neurologic features |
| 80356616 | KCNJ11 | NM_000525.3(KCNJ11): c.175G>A (p.Val59Met) | GGACRTGTTCACCACGCTGGTGG, GCAGGACRTGTTCACCACGCTGG | Permanent neonatal diabetes mellitus, Diabetes mellitus, permanent neonatal, with neurologic features, Neonatal insulin-dependent diabetes mellitus |
| 267607196 | KCNJ11 | NM_000525.3(KCNJ11): c.844G>A (p.Glu282Lys) | CCTCRAGATCATCGTCATCCTGG | Islet cell hyperplasia |
| 80356625 | KCNJ11 | NM_000525.3(KCNJ11): c.601C>T (p.Arg201Cys) | CCGCCTCTGCTTCATGCTAYGTG, CCTCTGCTTCATGCTAYGTGTGG | Permanent neonatal diabetes mellitus, Diabetes mellitus, permanent neonatal, with neurologic features, Diabetes mellitus |
| 527236152 | KCNJ18 | NM_001194958.2(KCNJ18): c.419C>T (p.Thr140Met) | CCTCTTCTCCATCGAGAYGCAGA | Thyrotoxic periodic paralysis |
| 527236157 | KCNJ18 | NM_001194958.2(KCNJ18): c.1219C>T (p.Gln407Ter) | CCGGGATGGCCTCAGCCCCYAGG | Thyrotoxic periodic paralysis |
| 527236158 | KCNJ18 | NM_001194958.2(KCNJ18): c.1061C>T (p.Thr354Met) | CCTATGAGGTGCCCTCTAYGCCC | Thyrotoxic periodic paralysis, Thyrotoxic periodic paralysis 2 |
| 104894584 | KCNJ2 | NM_000891.2(KCNJ2): c.514G>A (p.Asp172Asn) | ATCATCRATGCTTTCATCATTGG | Short QT syndrome 3, short QT syndrome |
| 104894581 | KCNJ2 | NM_000891.2(KCNJ2): c.557C>T (p.Pro186Leu) | CCAAGATGGCAAAGCYAAAGAAG | Andersen Tawil syndrome, Congenital long QT syndrome |
| 786204795 | KCNJ6 | NM_002240.4(KCNJ6): c.460G>A (p.Gly154Ser) | CACCATTRGTTATGGCTACCGGG, CCACCATTRGTTATGGCTACCGG | Keppen-Lubinsky syndrome |
| 121908332 | KCNK9 | NM_001282534.1(KCNK9): c.706G>A (p.Gly236Arg) | CATCRGGGCCTTCCTCAACCTGG | Birk Barel mental retardation dysmorphism syndrome |
| 794728531 | KCNQ1 | NM_000218.2(KCNQ1): c.1685+1G>A | AGGAGRTGGGCACGGCCAAACGG | Cardiac arrhythmia |
| 794728539 | KCNQ1 | NM_000218.2(KCNQ1): c.1794G>A (p.Lys598=) | GACAARGTAGGCTCACGCGCCGG | Cardiac arrhythmia |
| 794728553 | KCNQ1 | NM_000218.2(KCNQ1): c.343G>A (p.Glu115Lys) | TCCTCRAGCGTCCCACCGGCTGG | Cardiac arrhythmia |
| 794728572 | KCNQ1 | NM_000218.2(KCNQ1): c.176G>A (p.Trp392Ter) | CTGRAAGATCTACATCCGGAAGG, CCACCTGRAAGATCTACATCCGG | Cardiac arrhythmia |
| 17215479 | KCNQ1 | NM_000218.2(KCNQ1): c.643G>A (p.Val215Met) | CTGRATGGGCTCCAAGGGGCAGG, TCCTCTGCRTGGGCTCCAAGGGG | Congenital long QT syndrome, Long QT syndrome, LQT1 subtype |
| 120074183 | KCNQ1 | NM_000218.2(KCNQ1): c.1034G>A (p.Gly345Glu) | CCCAGGRGATTCTTGGCTCGGGG, TCCCAGGRGATTCTTGGCTCGGG, TTCCCAGGRGATTCTTGGCTCGG | Long QT syndrome 1, Congenital long QT syndrome, Long QT syndrome, LQT1 subtype |
| 120074187 | KCNQ1 | NM_000218.2(KCNQ1): c.898G>A (p.Ala300Thr) | TACRCAGATGCGCTGTGGTGGGG, CTACRCAGATGCGCTGTGGTGGG, GCTACRCAGATGCGCTGTGGTGG, GCAGCTACRCAGATGCGCTGTGG | Long QT syndrome 1, Cardiac arrhythmia, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 120074188 | KCNQ1 | NM_000218.2(KCNQ1): c.1573G>A (p.Ala525Thr) | TGTGRCCAAGAAGAAATTCCAGG | Congenital long QT syndrome, Cardiac arrhythmia, Long QT syndrome, LQT1 subtype |
| 199472688 | KCNQ1 | NM_000218.2(KCNQ1): c.436G>A (p.Glu146Lys) | CATCRAGCAGTATGCCGCCCTGG | Congenital long QT syndrome, Long QT syndrome, LQT1 subtype |
| 199472692 | KCNQ1 | NM_000218.2(KCNQ1): c.484G>A (p.Val162Met) | ATCRTGCTGGTGGTGTTCTTCGG | Congenital long QT syndrome, Cardiac arrhythmia |
| 199472694 | KCNQ1 | NM_000218.2(KCNQ1): c.514G>A (p.Val172Met) | CGGAGTACRTGGTCCGCCTCTGG | Congenital long QT syndrome |
| 199472736 | KCNQ1 | NM_000218.2(KCNQ1): c.875G>A (p.Gly292Asp) | GAGTCAGRCCGCGTGGAGTTCGG | Congenital long QT syndrome, Cardiac arrhythmia |
| 199472811 | KCNQ1 | NM_000218.2(KCNQ1): c.1750G>A (p.Gly584Ser) | GATCGCRGCAGCAACACGATCGG | Sudden infant death syndrome |
| 199473464 | KCNQ1 | NM_000218.2(KCNQ1): c.868G>A (p.Glu290Lys) | GGTGAACRAGTCAGGCCGCGTGG | Congenital long QT syndrome, Long QT syndrome, LQT1 subtype |
| 199473482 | KCNQ1 | NM_000218.2(KCNQ1): c.1748G>A (p.Arg583His) | GATCRCGGCAGCAACACGATCGG | Congenital long QT syndrome, Cardiac arrhythmia |
| 762814879 | KCNQ1 | NM_000218.2(KCNQ1): c.477+1G>A | GGATGRTACGTAGCATCTGAGGG, TGGATGRTACGTAGCATCTGAGG | Cardiac arrhythmia |
| 151344631 | KCNQ1 | NM_000218.2(KCNQ1): c.613G>A (p.Val205Met) | CATCRTGGTCGTGGCCTCCATGG | Long QT syndrome 1, Long QT syndrome, Congenital long QT syndrome, Cardiac arrhythmia, Long QT syndrome, LQT1 subtype, not provided |
| 149089817 | KCNQ1 | NM_000218.2(KCNQ1): c.1336G>A (p.Asp446Asn) | CGTGCRACCCCCAGAAGAGCGG | Cardiac arrhythmia |
| 397508070 | KCNQ1 | NM_000218.2(KCNQ1): c.1032+1G>A | CCCAGCGRTAGGTGCCCCGTGGG, TCCCAGCGRTAGGTGCCCCGTGG | Long QT syndrome, Cardiac arrhythmia, Long QT syndrome, LQT1 subtype |
| 140452381 | KCNQ1 | NM_000218.2(KCNQ1): c.1354C>T (p.Arg452Trp) | CCCCCCAGAAGAGCGGYGGCTGG, CCCCCAGAAGAGCGGYGGCTGGA, CCCCAGAAGAGCGGYGGCTGGAC | Long QT syndrome, Congenital long QT syndrome, Cardiac arrhythmia, Long QT syndrome, LQT1 subtype |
| 199472787 | KCNQ1 | NM_000218.2(KCNQ1): c.1555C>T (p.Arg519Cys) | CCATTAAGGTCATTCGAYGCATG | Congenital long QT syndrome |
| 199473446 | KCNQ1 | NM_000218.2(KCNQ1): c.197C>T (p.Ser66Phe) | CCCGCGCCCCTGCGTYCCCGGC, CCGCGCCCCTGCGTYCCCGCC | Congenital long QT syndrome |
| 199473450 | KCNQ1 | NM_000218.2(KCNQ1): c.409C>T (p.Leu137Phe) | CCTCATCGTCCTGGTCTGCYTCA | Congenital long QT syndrome, Cardiac arrhythmia, Long QT syndrome, LQT1 subtype |
| 775479779 | KCNQ1 | NM_000218.2(KCNQ1): c.642C>A (p.Cys214Ter) | CCTCCATGGTGGTCCTCTGHGTG, CCATGGTGGTCCTCTGHGTGGGC | Cardiac arrhythmia |
| 397508075 | KCNQ1 | NM_000218.2(KCNQ1): c.1075C>T (p.Gln359Ter) | CCTGAAGGTGCAGCAGAAGYAGA | Cardiac arrhythmia, Long QT syndrome, LQT1 subtype |
| 397508097 | KCNQ1 | NM_000218.2(KCNQ1): c.1588C>T (p.Gln530Ter) | CCAAGAAGAAATTCYAGGTAAGC | Long QT syndrome, Cardiac arrhythmia |
| 796052642 | KCNQ2 | NM_172107.2(KCNQ2): c.1009G>A (p.Ala337Thr) | CCCGGCARCAGGCCTGATCCAGG | not provided |
| 397514581 | KCNQ2 | NM_172107.2(KCNQ2): c.638G>A (p.Arg213Gln) | TGGACCRGCGGGGAGGCACCTGG | Early infantile epileptic encephalopathy 7, not provided |
| 397514582 | KCNQ2 | NM_172107.2(KCNQ2): c.869G>A (p.Gly290Asp) | CTGGAACGRCAGGCTCCTTGCGG | Early infantile epileptic encephalopathy 7 |
| 587777219 | KCNQ2 | NM_172107.2(KCNQ2): c.794C>T (p.Ala265Val) | CATCCRCGTAGGTGTCAAAGTGG | Early infantile epileptic encephalopathy 7, not provided |
| 796052634 | KCNQ2 | NM_172107.2(KCNQ2): c.809G>A (p.Trp270Ter) | TGGTRGGGCCTGGTGAGTTGTGG | not provided |
| 118192190 | KCNQ2 | NM_172107.2(KCNQ2): c.296+1G>A | CTACGTRTGAGTGGCCGGCGGGG, CCTACGTRTGAGTGGCCGGCGGG, GCCTACGTRTGAGTGGCCGGCGG | Benign familial neonatal seizures 1 |
| 118192200 | KCNQ2 | NM_172107.2(KCNQ2): c.620G>A (p.Arg207Gln) | TGCRGATGATCCGCATGGACCGG, GATTCTGCRGATGATCCGCATGG | Benign familial neonatal seizures 1, Seizures, benign familial neonatal, 1, and/or myokymia, not provided |
| 118192216 | KCNQ2 | NM_172107.2(KCNQ2): c.998G>A (p.Arg333Gln) | AAGAGGCRGAACCCGGCAGCAGG | Benign familial neonatal seizures 1 |
| 794727740 | KCNQ2 | NM_172107.2(KCNQ2): c.793G>A (p.Ala265Thr) | TACRCGGATGCACTCTGGTGGGG, CTACRCGGATGCACTCTGGTGGG, CCTACRCGGATGCACTCTGGTGG, ACACCTACRCGGATGCACTCTGG | Benign familial neonatal seizures 1, Seizures, Early infantile epileptic encephalopathy 7, not provided |
| 118192214 | KCNQ2 | NM_172107.2(KCNQ2): c.967C>T (p.Gln323Ter) | CCCTGAAGGTTCAGGAGYAGCAC, CCTGAAGGTTCAGGAGYAGCACA | Benign familial neonatal seizures 1 |
| 118192224 | KCNQ2 | NM_172107.2(KCNQ2): c.1288C>T (p.Pro430Ser) | CCCCTGTGTGGATGCTGCYCCGG, CCCTGTGTGGATGCTGCYCCGGA, CCTGTGTGGATGCTGCYCCGGAC | Benign familial neonatal seizures 1 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 118192236 | KCNQ2 | NM_172107.2(KCNQ2): c.1741C>T (p.Arg581Ter) | CCACCTGGACATGCTGTCCYGAA, CCTGGACATGCTGTCCYGAATTA | Benign familial neonatal seizures 1, not provided |
| 118192251 | KCNQ3 | NM_004519.3(KCNQ3): c.988C>T (p.Arg330Cys) | CCCAAAACGTGGGAAGGCYGTCT, CCAAAACGTGGGAAGGCYGTCTG | Benign familial neonatal seizures 2 |
| 28939710 | KCNQ4 | NM_004700.3(KCNQ4): c.961G>A (p.Gly321Ser) | AGGCTCCRGCTTTGCCCTGAAGG | DFNA 2 Nonsyndromic Hearing Loss |
| 80358279 | KCNQ4 | NM_004700.3(KCNQ4): c.886G>A (p.Gly296Ser) | CTGRGCAGGGTCCTGGCTGCTGG | DFNA 2 Nonsyndromic Hearing Loss |
| 397515402 | KCNT1 | NM_020822.2(KCNT1): c.1283G>A (p.Arg428Gln) | CAGCRGGTCATCTACCTCCAGGG, CCAGCRGGTCATCTACCTCCAGG | Early infantile epileptic encephalopathy 14, Epilepsy, nocturnal frontal lobe, 5 |
| 397515404 | KCNT1 | NM_020822.2(KCNT1): c.1421G>A (p.Arg474His) | CCTGCRCGCCTGGGCCGTGAAGG | Early infantile epileptic encephalopathy 14 |
| 587777264 | KCNT1 | NM_020822.2(KCNT1): c.862G>A (p.Gly288Ser) | GACCTGCRGCATCCAGCACCTGG | Early infantile epileptic encephalopathy 14 |
| 397515405 | KCNT1 | NM_020822.2(KCNT1): c.2782C>T (p.Arg928Cys) | CCCACCCTTCCAACATGYGCTTC, CCACCCTTCCAACATGYGCTTCA | Epilepsy, nocturnal frontal lobe, 5 |
| 387907302 | KCNV2 | NM_133497.3(KCNV2): c.226C>T (p.Gln76Ter) | CCTGGCAGAAGAGGACYAGCAGG | Retinal cone dystrophy 3B |
| 786205860 | KCTD17 | NM_001282684.1(KCTD17): c.434G>A (p.Arg145His) | GTACCRCGTGCTGCAGTGCCAGG | DYSTONIA 26, MYOCLONIC |
| 387907260 | KCTD7 | NM_153033.4(KCTD7): c.280C>T (p.Arg94Trp) | CCCCACGGACTCCGAGGGCYGGT, CCACGGACTCCGAGGGCYGGTA, CCACGGACTCCGAGGGCYGGTAC | Epilepsy, progressive myoclonic 3 |
| 199422234 | KDM5C | NM_004187.3(KDM5C): c.2191C>T (p.Leu731Phe) | CCCAGACGGCCTTGTCTGCYTTT, CCAGACGGCCTTGTCTGCYTTTC | Mental retardation, syndromic, Claes-Jensen type, X-linked |
| 121917860 | KERA | NM_007035.3(KERA): c.520C>T (p.Gln174Ter) | CCTGACCCTTCTTGACCTAYAGA, CCCTTCTTGACCTAYAGAACAAC | Cornea plana 2 |
| 730882122 | KIF11 | NM_004523.3(KIF11): c.790-1G>A | AAATTAAARGTTGATCTTGCAGG | Microcephaly with or without chorioretinopathy, lymphedema, or mental retardation |
| 672601369 | KIF1A | NM_001244008.1(KIF1A): c.757G>A (p.Glu253Lys) | AGCRAGCGGGCTGACTCCACGGG, GAGCRAGCGGGCTGACTCCACGG | Mental retardation, autosomal dominant 9 |
| 267607200 | KIF21A | NM_001173464.1(KIF21A): c.2841G>A (p.Met947Ile) | AGATATRATAGACTTCCTCAAGG | Fibrosis of extraocular muscles, congenital, 3b |
| 121912585 | KIF21A | NM_001173464.1(KIF21A): c.2860C>T (p.Arg954Trp) | CCTGCTTTCTCAATAGCAAYGGG | Fibrosis of extraocular muscles, congenital, 1, Fibrosis of extraocular muscles, congenital, 3b |
| 387907288 | KIF5A | NM_004984.2(KIF5A): c.839G>A (p.Arg280His) | ATCRTGACAGCAAAATGACAAGG | Spastic paraplegia 10 |
| 387907289 | KIF5A | NM_004984.2(KIF5A): c.704G>A (p.Gly235Glu) | GCAGRGAGTGAGAAGGTAGGGGG, GGCAGRGAGTGAGAAGGTAGGGG, TGGCAGRGAGTGAGAAGGTAGGG, CTGGCAGRGAGTGAGAAGGTAGG | Spastic paraplegia 10 |
| 121434444 | KIF5A | NM_004984.2(KIF5A): c.1082C>T (p.Ala361Val) | CCCAGAAGGAGACGATTGYGAAG, CCAGAAGGAGACGATTGYGAAGC | Spastic paraplegia 10 |
| 794727316 | KIF7 | NM_198525.2(KIF7): c.61C>T (p.Arg21Ter) | CCCAGTGCGGGTTGCCCTGYGAG, CCAGTGCGGGTTGCCCTGYGAGT | Acrocallosal syndrome, Schinzel type |
| 104894701 | KISS1R | NM_032551.4(KISS1R): c.991C>T (p.Arg331Ter) | CCTGGGCTCGCACTTCYGACAGG | |
| 794726675 | KIT | NM_000222.2(KIT): c.1879+1G>A | CTCAAGCRTAAGTTCCTGTATGG | Partial albinism |
| 121913680 | KIT | NM_000222.2(KIT): c.1747G>A (p.Glu583Lys) | AATGGRAGTTTCCCAGAAACAGG | Partial albinism |
| 370756367 | KLHL10 | NM_152467.3(KLHL10): c.937G>A (p.Ala313Thr) | TGACRCTCGGGCAGACAGATGGG, ATGACRCTCGGGCAGACAGATGG | Spermatogenic failure 11 |
| 199469643 | KLHL3 | NM_017415.2(KLHL3): c.1292G>A (p.Arg431Gln) | CGGCRGAGCAGTGTGGGTGTGGG, GCGGCRGAGCAGTGTGGGTGTGG | Pseudohypoaldosteronism, type 2 |
| 199469628 | KLHL3 | NM_017415.2(KLHL3): c.1019C>T (p.Ala340Val) | CCTTCCAGAAGATGCAGAGYAGG, CCAGAAGATGCAGAGYAGGTGAG | Pseudohypoaldosteronism, type 2 |
| 730882260 | KLHL41 | NM_006063.2(KLHL41): c.1238C>T (p.Ser413Leu) | CCTTCAAACAGAGGCTTYGCTGG | Nemaline myopathy 9 |
| 104894704 | KLK4 | NM_004917.4(KLK4): c.458G>A (p.Trp153Ter) | GGCTRGGGTCTGCTGGCGAACGG | Amelogenesis imperfecta, hypomaturation type, IIA1 |
| 794727420 | KMT2D | NM_003482.3(KMT2D): c.5677C>T (p.Gln1893Ter) | CCAAGGACCTGCAGYAGCTCTTC | Kabuki make-up syndrome |
| 794727549 | KMT2D | NM_003482.3(KMT2D): c.7903C>T (p.Arg2635Ter) | CCCATGGAGCCTCACAGYGATCA, CCATGGAGCCTCACAGYGATCAG | Kabuki make-up syndrome |
| 587783685 | KMT2D | NM_003482.3(KMT2D): c.12592C>T (p.Arg4198Ter) | CCTACGGTGGGTCAGCTTYGAGC | Kabuki make-up syndrome |
| 587783699 | KMT2D | NM_003482.3(KMT2D): c.15943C>T (p.Gln5315Ter) | CCCGGGGTGGAGAGCTGTYAAAA, CCGGGGTGGAGAGCTGTYAAAAC | Kabuki make-up syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587783711 | KMT2D | NM_003482.3(KMT2D): c.3121C>T (p.Gln1041Ter) | CCAAAACTCCCCTCCTTCCYAGT | Kabuki make-up syndrome |
| 398123704 | KMT2D | NM_003482.3(KMT2D): c.11149C>T (p.Gln3717Ter) | CCTGATTCAAGGCTTTTAYAGGA | Kabuki make-up syndrome, not provided |
| 398123708 | KMT2D | NM_003482.3(KMT2D): c.11692C>T (p.Gln3898Ter) | CCCATGGGCTCTTTAYAGCAGCT, CCATGGGCTCTTTAYAGCAGCTT | Kabuki make-up syndrome, not provided |
| 398123711 | KMT2D | NM_003482.3(KMT2D): c.12406C>T (p.Gln4136Ter) | CCCCACCTGCTGGCTYAGCCCTC, CCCACCTGCTGGCTYAGCCCTCT | Kabuki make-up syndrome, not provided |
| 398123721 | KMT2D | NM_003482.3(KMT2D): c.14710C>T (p.Arg4904Ter) | CCAATCTGGATGTGYGACAGCTC | Kabuki make-up syndrome, not provided |
| 398123757 | KMT2D | NM_003482.3(KMT2D): c.7066C>T (p.Gln2356Ter) | CCAGGAGCCACCCCCTGCCYAGG | Kabuki make-up syndrome, not provided |
| 59977263 | KRT17 | NM_000422.2(KRT17): c.304G>A (p.Val102Met) | CAAGRTGCGTGCCCTGGAGGAGG, GGACAAGRTGCGTGCCCTGGAGG | Pachyonychia congenita type 2, not provided |
| 137852629 | KRT2 | NM_000423.2(KRT2): c.1459G>A (p.Glu487Lys) | AGGGCRAGGAGTGCAGGTGAGGG, GAGGGCRAGGAGTGCAGGTGAGG | Ichthyosis bullosa of Siemens, Ichthyosis exfoliativa, not provided |
| 121912476 | KRT5 | NM_000424.3(KRT5): c.1252G>A (p.Glu418Lys) | TGCCRAGCAGCGTGGGGAGCTGG | Epidermolysis bullosa simplex, autosomal recessive, not provided |
| 57499817 | KRT5 | NM_000424.3(KRT5): c.74C>T (p.Pro25Leu) | CCGCCTCTGCCATCACCCYGTCT, CCTCTGCCATCACCCYGTCTGTC | Epidermolysis bullosa simplex with mottled pigmentation, not provided |
| 60554162 | KRT6A | NM_005554.3(KRT6A): c.1414G>A (p.Glu472Lys) | GGAGGGTRAGGAGTGCAGGTGGG, TGGAGGGTRAGGAGTGCAGGTGG | PC-K6a, not provided |
| 60627726 | KRT6B | NM_005555.3(KRT6B): c.1414G>A (p.Glu472Lys) | GGAGGGCRAGGAGTGCAGGTGGG, TGGAGGGCRAGGAGTGCAGGTGG | Pachyonychia congenita 4, not provided |
| 587777292 | KRT6C | NM_173086.4(KRT6C): c.1414G>A (p.Glu472Lys) | CCTACCTGCACTCCTYGCCCTCC | Palmoplantar keratoderma, nonepidermolytic, focal or diffuse |
| 57802288 | KRT83 | NM_002282.3(KRT83): c.1219G>A (p.Glu407Lys) | ATATCRAGATCGCCACCTACAGG | Beaded hair, not provided |
| 57019720 | KRT9 | NM_000226.3(KRT9): c.511G>A (p.Val171Met) | TAAGRTGCAGGCTCTAGAGGAGG, GGATAAGRTGCAGGCTCTAGAGG | Epidermolytic palmoplantar keratoderma, not provided |
| 137852519 | L1CAM | NM_000425.4(L1CAM): c.1792G>A (p.Asp598Asn) | ACTGRATGTGGTGGAGAGTAGGG, AACTGRATGTGGTGGAGAGTAGG | Spastic paraplegia 1 |
| 137852524 | L1CAM | NM_000425.4(L1CAM): c.1108G>A (p.Gly370Arg) | ATCAACRGGATCCCTGTGGAGGG, AATCAACRGGATCCCTGTGGAGG | Spastic paraplegia 1 |
| 137852525 | L1CAM | NM_000425.4(L1CAM): c.2254G>A (p.Val752Met) | CGCRTGCAGTGGCGCCCTCAGGG, CCGCRTGCAGTGGCGCCCTCAGG | |
| 118204021 | L2HGDH | NM_024884.2(L2HGDH): c.164G>A (p.Gly55Asp) | TCGTTGRTGGCGGAATTGTGGGG, ATCGTTGRTGGCGGAATTGTGGG, CATCGTTGRTGGCGGAATTGTGG | L-2-hydroxyglutaric aciduria |
| 121913574 | LAMA2 | NM_000426.3(LAMA2): c.1580G>A (p.Cys527Tyr) | ACAGATRTCAGAGTTCCTACTGG | Congenital muscular dystrophy due to partial LAMA2 deficiency, not provided |
| 398123367 | LAMA2 | NM_000426.3(LAMA2): c.112+1G>A | AAGAGRTACAGTCGAGGCATGGG, AAAGAGRTACAGTCGAGGCATGG | Merosin deficient congenital muscular dystrophy, not provided |
| 9492297 | LAMA2 | NM_000426.3(LAMA2): c.2750-1G>C | GCARCCTGTCGCTGTAATGCCGG | Merosin deficient congenital muscular dystrophy, not provided |
| 398123391 | LAMA2 | NM_000426.3(LAMA2): c.9212-1G>A | TCARATGACCTCAAGCAGTTTGG | Merosin deficient congenital muscular dystrophy, not provided |
| 121913571 | LAMA2 | NM_000426.3(LAMA2): c.9253C>T (p.Arg3085Ter) | CCAGTATTCCGTTCYGAGGTTGC | Merosin deficient congenital muscular dystrophy |
| 121913572 | LAMA2 | NM_000426.3(LAMA2): c.7732C>T (p.Arg2578Ter) | CCACCTAGGAGAAAAYGAAGGCA | Merosin deficient congenital muscular dystrophy, not provided |
| 727502851 | LAMA2 | NM_000426.3(LAMA2): c.7888C>T (p.Arg2630Ter) | CCGTTCATGTAGAGYGAACTAGA | Congenital muscular dystrophy |
| 398123373 | LAMA2 | NM_000426.3(LAMA2): c.3976C>T (p.Arg1326Ter) | CCATAGAACTGTGACCYGAGAAG | Merosin deficient congenital muscular dystrophy, not provided |
| 398123378 | LAMA2 | NM_000426.3(LAMA2): c.5914C>T (p.Gln1972Ter) | CCAAAGGCTGTCTTYAGAAAAGC | Merosin deficient congenital muscular dystrophy, not provided |
| 137852757 | LAMA3 | NM_198129.2(LAMA3): c.6808C>T (p.Arg2270Ter) | CCAATCTCACAACTCTCYGAGAT | Junctional epidermolysis bullosa gravis of Herlitz |
| 137852758 | LAMA3 | NM_198129.2(LAMA3): c.8962C>T (p.Gln2988Ter) | CCAATCATGGAGCCCTCYAGTTT | Adult junctional epidermolysis bullosa |
| 730880125 | LAMB2 | NM_002292.3(LAMB2): c.2890C>T (p.Arg964Ter) | CCGTGGGCAGGGCTGYGATGTGA | Pierson syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 267607208 | LAMB2 | NM_002292.3(LAMB2): c.4177C>T (p.Leu1393Phe) | CCAGCGGGCACTTGGCAAGYTCT | Nephrotic syndrome, type 5, with or without ocular abnormalities |
| 121912484 | LAMB3 | NM_000228.2(LAMB3): c.1830G>A (p.Trp610Ter) | GTGRTCAGGGCCTGGGCTGGAGG, CCTGTGRTCAGGGCCTGGGCTGG | Junctional epidermolysis bullosa gravis of Herlitz |
| 80356681 | LAMB3 | NM_000228.2(LAMB3): c.727C>T (p.Gln243Ter) | CCTACTATGCTGTGTCCYAGCTC | Junctional epidermolysis bullosa gravis of Herlitz |
| 121912483 | LAMB3 | NM_000228.2(LAMB3): c.496C>T (p.Gln166Ter) | CCGCCAGGGTCGGCCTYAGAGCT | Junctional epidermolysis bullosa gravis of Herlitz |
| 587776812 | LAMB3 | NM_000228.2(LAMB3): c.628+42G>A | CCAACTCTGTTTCCTTTYCCACC | Adult junctional epidermolysis bullosa |
| 387906887 | LAMC3 | NM_006059.3(LAMC3): c.1156C>T (p.Gln386Ter) | CCAGCCCTGTGACTGCYAGTCGG | Cortical malformations, occipital |
| 104894858 | LAMP2 | NM_002294.2(LAMP2): c.928G>A (p.Val310Ile) | GGCTCCRGTAAGCAAAGCACTGG | Cardiomyopathy, Danon disease |
| 398124181 | LARGE | NM_004737.4(LARGE): c.1102C>T (p.Gln368Ter) | CCACACCCGCTCCGAGYAGTGCT | not provided |
| 398123036 | LARS2 | NM_015340.3(LARS2): c.1886C>T (p.Thr629Met) | CCTGTTCATGCAAAAAYGAAAGA | Perrault syndrome 4 |
| 121908050 | LCAT | NM_000229.1(LCAT): c.440C>T (p.Thr147Ile) | CCCACAGGGTACCTGCACAYACT, CCACAGGGTACCTGCACAYACTG | Fish-eye disease |
| 387906300 | LCAT | NM_000229.1(LCAT): c.544C>T (p.Arg182Cys) | CCAGCAGGAGGAGTACTACYGCA | Norum disease |
| 45514002 | LDB3 | NM_007078.2(LDB3): c.2017G>A (p.Asp673Asn) | TGCRATTTCCCCGTGGAGGCTGG, TGGCTGCRATTTCCCCGTGGAGG | Dilated cardiomyopathy 1C, Left ventricular noncompaction 3 |
| 45487699 | LDB3 | NM_007078.2(LDB3): c.566C>T (p.Ser189Leu) | CCAAAAGCCCTGCCGGGCTYGAG | Dilated cardiomyopathy 1C, not specified, not provided, Familial hypertrophic cardiomyopathy 24 |
| 121908335 | LDB3 | NM_001080116.1(LDB3): c.802C>T (p.Arg268Cys) | CCCACGTTTTGCCAAATTGYGCA, CCACGTTTTGCCAAATTGYGCAA | Myofibrillar myopathy, ZASP-related, not specified |
| 121908337 | LDB3 | NM_007078.2(LDB3): c.617C>T (p.Thr206Ile) | CCTGTACTCGGCAGAGAYCCTGA | Dilated cardiomyopathy 1C |
| 375009082 | LDLR | NM_000527.4(LDLR): c.2098G>A (p.Asp700Asn) | CTGCCCGRACGGCATGCTGCTGG | not provided |
| 121908033 | LDLR | NM_000527.4(LDLR): c.523G>A (p.Asp175Asn) | GCGAARATGGCTCGGATGAGTGG | Familial hypercholesterolemia |
| 121908037 | LDLR | NM_000527.4(LDLR): c.2531G>A (p.Gly844Asp) | GGACGRCTACAGCTACCCCTCGG | Familial hypercholesterolemia |
| 768563000 | LDLR | NM_000527.4(LDLR): c.718G>A (p.Glu240Lys) | GACRAATTCCAGTGCTCTGATGG | not provided |
| 28942081 | LDLR | NM_000527.4(LDLR): c.1637G>A (p.Gly546Asp) | GAAAGGGRCCTGAATGGTGTGG | Familial hypercholesterolemia |
| 139361635 | LDLR | NM_000527.4(LDLR): c.1024G>A (p.Asp342Asn) | CCCCRACGGCTTCCAGCTGGTGG, GTGCCCCRACGGCTTCCAGCTGG | Hypercholesterolaemia, not provided |
| 387906303 | LDLR | NM_000527.4(LDLR): c.670G>A (p.Asp224Asn) | CTGCAAGRACAAATCTGACGAGG | Familial hypercholesterolemia |
| 121908026 | LDLR | NM_000527.4(LDLR): c.530C>T (p.Ser177Leu) | CCCGACTGCGAAGATGGCTYGGA, CCGACTGCGAAGATGGCTYGGAT | Familial hypercholesterolemia, not provided |
| 121908044 | LDLR | NM_000527.4(LDLR): c.621C>T (p.Gly207=) | CCACTGCCTAAGTGGYGAGTGCA | Familial hypercholesterolemia |
| 752596535 | LDLR | NM_000527.4(LDLR): c.501C>A (p.Cys167Ter) | CCCCCAGCTGTGGGCCTGHGACA, CCCCAGCTGTGGGCCTGHGACAA, CCCAGCTGTGGGCCTGHGACAAC, CCAGCTGTGGGCCTGHGACAACG | not provided |
| 121908324 | LDLRAP1 | NM_015627.2(LDLRAP1): c.65G>A (p.Trp22Ter) | AGAGCTRGGGGGCGGTGGCCGG | Hypercholesterolemia, autosomal recessive |
| 121909126 | LEFTY2 | NM_003240.3(LEFTY2): c.1025G>A (p.Ser342Asn) | GGTCARCCTGCCCAACATGAGGG, TGGTCARCCTGCCCAACATGAGG | Left-right axis malformations |
| 121909125 | LEFTY2 | NM_003240.3(LEFTY2): c.940C>T (p.Arg314Ter) | CCATTTCTGGGGCCGYGACAGTG | Left-right axis malformations |
| 121912517 | LHB | NM_000894.2(LHB): c.167G>A (p.Gly56Asp) | TGCCGRCTACTGCCCCACCATGG | Isolated lutropin deficiency |
| 137854503 | LHX3 | NM_178138.4(LHX3): c.629C>T (p.Ala210Val) | CCAGAACCGCCGGGYCAAGGAGA | Pituitary hormone deficiency, combined 3 |
| 121912642 | LHX4 | NM_033343.3(LHX4): c.250C>T (p.Arg84Cys) | CCTGCTGCCCTGACAGGYGCTTC | Pituitary hormone deficiency, combined 4 |
| 121434560 | LIG1 | NM_000234.2(LIG1): c.1696G>A (p.Glu566Lys) | CCTGCRAATACAAATATGACGGG, ACCTGCRAATACAAATATGACGG | |
| 121434561 | LIG1 | NM_000234.2(LIG1): c.2311C>T (p.Arg771Trp) | CCTGGGCCGGGGAAGYGGGCCG | |
| 104894420 | LIG4 | NM_002312.3(LIG4): c.1406G>A (p.Gly469Glu) | GTTGGAGRATATTGGGGTAAAGG | Lig4 syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894419 | LIG4 | NM_002312.3(LIG4): c.2440C>T (p.Arg814Ter) | CCTCTCAGTATGTTTYGACGCCA | Lig4 syndrome |
| 116928232 | LIPA | NM_000235.3(LIPA): c.894G>A (p.Gln298=) | CCTGGAATGCCTACYTGGCTCCA | Lysosomal acid lipase deficiency |
| 104894519 | LITAF | NM_004862.3(LITAF): c.334G>A (p.Gly112Ser) | ATAACGCCRGTGCTCTGACCTGG | CHARCOT-MARIE-TOOTH DISEASE, DEMYELINATING, TYPE 1C |
| 587777626 | LMF1 | NM_022773.2(LMF1): c.1391G>A (p.Trp464Ter) | CCGCGAACCACATCAGCYAGTCC | Lipase deficiency combined |
| 794728589 | LMNA | NM_170707.3(LMNA): c.356+1G>A | GCGCGRTGAGTTCGCCCAGGTGG, AAAGCGCGRTGAGTTCGCCCAGG | not provided |
| 368386019 | LMNA | NM_170707.3(LMNA): c.1931G>A (p.Arg644His) | GTCACCCRCTCCTACCTCCTGGG, GGTCACCCRCTCCTACCTCCTGG | Congenital muscular dystrophy, not provided |
| 121912493 | LMNA | NM_170707.3(LMNA): c.1318G>A (p.Val440Met) | GCGCGRTGGCCGTGGAGGAGGTGG, CGGGCGCGRTGGCCGTGGAGGAGG | Mandibuloacral dysplasia with type A lipodystrophy, atypical, not provided |
| 121912494 | LMNA | NM_170707.3(LMNA): c.1585G>A (p.Ala529Thr) | ACGRCTCTCATCAACTCCACTGG | Mandibuloacral dysostosis, not provided |
| 61064130 | LMNA | NM_170707.3(LMNA): c.1822G>A (p.Gly608Ser) | GTGRGCGGACCCATCTCCTCTGG | Hutchinson-Gilford syndrome, not provided |
| 267607548 | LMNA | NM_170707.3(LMNA): c.1039G>A (p.Glu347Lys) | AGATGGCCRAGATGCGGGCAAGG | not provided |
| 267607552 | LMNA | NM_170707.3(LMNA): c.1380+1G>A | ATGAGRTAGGCTCCTGCTCAGGG, AATGAGRTAGGCTCCTGCTCAGG | not provided |
| 267607571 | LMNA | NM_170707.3(LMNA): c.569G>A (p.Arg190Gln) | GGCRGGTGGATGCTGAGAACAGG | not provided |
| 267607590 | LMNA | NM_170707.3(LMNA): c.1157+1G>A | GAGRTGGGCTGGGGAGACGTCGG | not provided |
| 267607592 | LMNA | NM_170707.3(LMNA): c.1608+1G>A | GAARTAAGTAGGCCTGGGCCTGG, CTGGGGAARTAAGTAGGCCTGGG | Limb-girdle muscular dystrophy, type 1B, not provided |
| 267607640 | LMNA | NM_170707.3(LMNA): c.1488+1G>A | ACGRTGAGTGGCAGGGCGCTTGG | Mandibuloacral dysostosis, not provided |
| 59270054 | LMNA | NM_170707.3(LMNA): c.244G>A (p.Glu82Lys) | CGCCTACRAGGCCGAGCTCGGGG, CCGCCTACRAGGCCGAGCTCGGG | Dilated cardiomyopathy 1A, not provided |
| 201583907 | LMNA | NM_170707.3(LMNA): c.1567G>A (p.Gly523Arg) | CTGCVGGAACAGCCTGCGTACGG | not specified, not provided |
| 28933093 | LMNA | NM_170707.3(LMNA): c.481G>A (p.Glu161Lys) | GGCRAGCTGCATGATCTGCGGGG, GGGCRAGCTGCATGATCTGCGGG, AGGGCRAGCTGCATGATCTGCGG | Dilated cardiomyopathy 1A, provided |
| 57508089 | LMNA | NM_170707.3(LMNA): c.1146C>T (p.Gly382=) | CCGCAAGCTCTTGGAGGGYGAGG | Dilated cardiomyopathy 1A, not provided |
| 794728591 | LMNA | NM_170707.3(LMNA): c.646C>T (p.Arg216Cys) | CCAACCCTTCCAGGAGCTGYGTG, CCCTTCCAGGAGCTGYGTGAGAC, CCTTCCAGGAGCTGYGTGAGACC | not provided |
| 60890628 | LMNA | NM_170707.3(LMNA): c.1718C>T (p.Ser573Leu) | CCCACTGCAGCAGCTYGGGGAC, CCACTGCAGCAGCTYGGGGACC | Dilated cardiomyopathy 1A, Lipodystrophy, familial partial, type 2, Mandibuloacral dysplasia with type A lipodystrophy, atypical, not specified, not provided |
| 56699480 | LMNA | NM_170707.3(LMNA): c.1477C>T (p.Gln493Ter) | CCCTGAAGGCTGGGYAGGTGGTG | Limb-girdle muscular dystrophy, type 1B, not provided |
| 58672172 | LMNA | NM_170707.3(LMNA): c.1195C>T (p.Arg399Cys) | CCCTACCTCGCAGCGCAGCYGTG, CCTACCTCGCAGCGCAGCYGTGG, CCTCGCAGCGCAGCYGTGGCCGT | Lipodystrophy, familial partial, type 2, not provided |
| 57920071 | LMNA | NM_005572.3(LMNA): c.1444C>T (p.Arg482Trp) | CCCTTGCTGACTTACYGGTTCCC, CCTTGCTGACTTACYGGTTCCCA | Lipodystrophy, familial partial, type 2, not provided |
| 267607554 | LMNA | NM_170707.3(LMNA): c.961C>T (p.Arg321Ter) | CCAAGGAGGCGAAGCTTYGAGAC | Dilated cardiomyopathy 1A, not provided |
| 267607587 | LMNA | NM_170707.3(LMNA): c.736C>T (p.Gln246Ter) | CCGGCTGGCGGATGCGCTYAGG | not provided |
| 57077886 | LMNA | NM_170707.3(LMNA): c.29C>T (p.Thr10Ile) | CCGTCCAGCGGCGCGCCAYCCG, CCCAGCGGCGCGCCAYCCGCAGC, CCAGCGGCGCGCCAYCCGCAGCG | Dilated cardiomyopathy 1A, provided |
| 61046466 | LMNA | NM_170707.3(LMNA): c.16C>T (p.Gln6Ter) | CCATGGAGACCCCGTCCYAGCGG | Benign scapuloperoneal muscular dystrophy with cardiomyopathy, Dilated cardiomyopathy 1A, not provided |
| 121909487 | LMX1B | NM_002316.3(LMX1B): c.661C>T (p.Arg221Ter) | CCCGCGGAGGCCCAAGYGACCCC, CCGCGGAGGCCCAAGYGACCCG | Nail-patella syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909490 | LMX1B | NM_002316.3(LMX1B): c.691C>T (p.Arg231Ter) | CCTCACCACGCAGCAGYGAAGA G | Nail-patella syndrome |
| 121909492 | LMX1B | NM_002316.3(LMX1B): c.745C>T (p.Arg249Ter) | CCTCTCTCTGAGCCAGGTCYGAG | Nail-patella syndrome |
| 201587138 | LOXHD1 | NM_144612.6(LOXHD1): c.4480C>T (p.Arg1494Ter) | ATCRCTCCCCAGTGTCCCCGAGG | Deafness, autosomal recessive 77 |
| 119480072 | LPIN1 | NM_145693.2(LPIN1): c.1162C>T (p.Arg388Ter) | CCGTTTTAGATAAAYGAAGCCGA | Myoglobinuria, acute recurrent, autosomal recessive |
| 118204070 | LPL | NM_000237.2(LPL): c.272G>A (p.Trp91Ter) | GAGTTRGGTGCCAAAACTTGTGG | Hyperlipoproteinemia, type I |
| 118204075 | LPL | NM_000237.2(LPL): c.665G>A (p.Gly222Glu) | TTGRAATCCAGAAACCAGTTGGG, ATTGRAATCCAGAAACCAGTTGG | Hyperlipoproteinemia, type I |
| 118204058 | LPL | NM_000237.2(LPL): c.397C>T (p.Gln133Ter) | CCAAACTGGTGGGAYAGGATGTG | Hyperlipoproteinemia, type I |
| 376610215 | LRIT3 | NM_198506.4(LRIT3): c.983G>A (p.Cys328Tyr) | CAAATRTAAGGCCAAAAATCTGG | Congenital stationary night blindness, type 1F |
| 397509378 | LRIT3 | NM_198506.4(LRIT3): c.1318C>T (p.Arg440Ter) | CCACCATGGCCAACAAGYGATCA, CCATGGCCAACAAGYGATCATTC | Congenital stationary night blindness, type 1F |
| 587776717 | LRP2 | NM_004525.2(LRP2): c.2640-1G>A | CCAGTACAATCGTGAAGCAYTAA | Donnai Barrow syndrome |
| 80338744 | LRP2 | NM_004525.2(LRP2): c.1093C>T (p.Arg365Ter) | CCAGAAGTGTGAAAGCYGACCTG | Donnai Barrow syndrome |
| 267607220 | LRP4 | NM_002334.3(LRP4): c.1585G>A (p.Asp529Asn) | GGACCRACTCAGGCACCTCGAGG | Syndactyly Cenani Lenz type |
| 267607221 | LRP4 | NM_002334.3(LRP4): c.479G>A (p.Cys160Tyr) | GAAGCTRCATTGCTGAGCATTGG | Syndactyly Cenani Lenz type |
| 746136135 | LRP4 | NM_002334.3(LRP4): c.3830G>A (p.Arg1277His) | CCAGTACCCTTGTCAGCAYGGTG | MYASTHENIC SYNDROME, CONGENITAL, 17 |
| 80358312 | LRP5 | NM_002335.3(LRP5): c.1709G>A (p.Arg570Gln) | CGAGCRGGTGCACAAGGTCAAGG | |
| 121908670 | LRP5 | NM_002335.3(LRP5): c.724G>A (p.Ala242Thr) | CTTCRCCCTGACGCTCTCCGGGG, CCTTCRCCCTGACGCTCTCCGGG, CCCTTCRCCCTGACGCTCTCCGG | Worth disease, Van Buchem disease type 2, Osteopetrosis autosomal dominant type 1 |
| 397514663 | LRP5 | NM_002335.3(LRP5): c.1655C>T (p.Thr552Met) | CCGCACATTTTTGGGTTCAYGCT | Osteoporosis with pseudoglioma |
| 397514664 | LRP5 | NM_002335.3(LRP5): c.1145C>T (p.Pro382Leu) | CCATCGACTACGACCYGCTAGAG | Osteoporosis with pseudoglioma |
| 397514665 | LRP5 | NM_002335.3(LRP5): c.731C>T (p.Thr244Met) | CCCCTTCGCCCTGAYGCTCTCCG | Osteoporosis with pseudoglioma |
| 80358308 | LRP5 | NM_002335.3(LRP5): c.1330C>T (p.Arg444Cys) | CCGCATCGAGGTGACGYGCCTCA | |
| 121908663 | LRP5 | NM_002335.3(LRP5): c.2557C>T (p.Gln853Ter) | CCCGTTCGGTCTGACGYAGTACA, CCGTTCGGTCTGACGYAGTACAG | Osteoporosis with pseudoglioma |
| 397515474 | LRP6 | NM_002336.2(LRP6): c.1418G>A (p.Arg473Gln) | ATTGAGCRAGCAGCTCTGGATGG | Coronary artery disease, autosomal dominant 2 |
| 137853187 | LRTOMT | NM_001145308.4(LRTOMT): c.328G>A (p.Glu110Lys) | TGCRAGTACTTGAGCCACATGGG, CTGCRAGTACTTGAGCCACATGG | Deafness, autosomal recessive 63 |
| 387907175 | LTBP2 | NM_000428.2(LTBP2): c.4313G>A (p.Cys1438Tyr) | GCTRCACCCAGGGCGCTAGCTGG | Microspherophakia |
| 137854856 | LTBP2 | NM_000428.2(LTBP2): c.3529G>A (p.Val1177Met) | AGATRTGAATGAGTGCATGGGGG, CAGATRTGAATGAGTGCATGGGG, GCAGATRTGAATGAGTGCATGGG, TGCAGATRTGAATGAGTGCATGG | Weill-Marchesani syndrome 1, Weill-Marchesani syndrome 3 |
| 121918356 | LTBP2 | NM_000428.2(LTBP2): c.331C>T (p.Gln111Ter) | CCGTCCCGCGCGCAGYAGTCGCG | Glaucoma 3, primary congenital, d |
| 137854855 | LTBP2 | NM_000428.2(LTBP2): c.1642C>T (p.Arg548Ter) | CCCAGCAGCACCCAGGCCTYGAG, CCAGCAGCACCCAGGCCTYGAGG | Marfan syndrome |
| 397515430 | LTBP4 | NM_001042544.1(LTBP4): c.1453C>T (p.Arg485Ter) | CCTGGGCCAGGAGCCACCCYGAG | Cutis laxa with severe pulmonary, gastrointestinal, and urinary abnormalities |
| 587777433 | LYRM7 | NM_181705.3(LYRM7): c.73G>A (p.Asp25Asn) | AATRATGCCAGAGCATTAGAAGG | MITOCHONDRIAL COMPLEX III DEFICIENCY, NUCLEAR TYPE 8 |
| 80338652 | LYST | NM_000081.3(LYST): c.3310C>T (p.Arg1104Ter) | CCTCACTTCAAAGTATAYGACTT | Ch\xc3\xa9diak-Higashi syndrome, Chediak-Higashi syndrome, adult type |
| 587777180 | LZTR1 | NM_006767.3(LZTR1): c.1397G>A (p.Arg466Gln) | CGCRGAGCCGCTGGCTTCGCAGG | Schwannomatosis 2 |
| 587777177 | LZTR1 | NM_006767.3(LZTR1): c.365C>T (p.Ser122Leu) | CCCCCCGTTACCACCACTGGCC, CCCCGTTACCACCACTGGCCG, CCCCGTTACCACCACTGGCCGT, CCCGTTACCACCACTGGCCGTC, CCGTTACCACCACTGGCCGTCG | Schwannomatosis 2 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 730880014 | MAFB | NM_005461.4(MAFB): c.161C>T | CCTGCAGCCAGCCGGCTYGGTGT | Multicentric osteolysis nephropathy |
| 387907007 | MAFB | NM_005461.4(MAFB): c.211C>T (p.Pro71Ser) | CCGTGCCCTCGTCGYCCAGCTTC | Multicentric osteolysis nephropathy |
| 387907008 | MAFB | NM_005461.4(MAFB): c.212C>T (p.Pro71Leu) | CCGTGCCCTCGTCGCYCAGCTTC | Multicentric osteolysis nephropathy |
| 398122418 | MAGEL2 | NM_019066.4(MAGEL2): c.3124C>T (p.Gln1042Ter) | CCAAGCCAAGGTGCCTGTCYAGC, CCAAGGTGCCTGTCYAGCGCTCG | Prader-Willi-like syndrome |
| 387906724 | MAGT1 | NM_032121.5(MAGT1): c.409C>T (p.Arg137Ter) | CCTGGCAAACTCCTGGYGATACT | Immunodeficiency, X-linked, with magnesium defect, Epstein-Barr virus infection, and neoplasia |
| 121909494 | MAMLD1 | NM_005491.4(MAMLD1): c.808C>T (p.Gln270Ter) | CCTTCCACCAGTAAGYAGATAGT | Hypospadias 2, X-linked |
| 387906886 | MAN1B1 | NM_016219.4(MAN1B1): c.1000C>T (p.Arg334Cys) | CCTGTTTGAGAGCACGATCYGCA | Mental retardation, autosomal recessive 15 |
| 80338679 | MAN2B1 | NM_000528.3(MAN2B1): c.2165+1G>A | TGGGRTGAGTGGCACAGGCTGGG, GTGGGRTGAGTGGCACAGGCTGG | Deficiency of alpha-mannosidase |
| 398123455 | MAN2B1 | NM_000528.3(MAN2B1): c.1929G>A (p.Trp643Ter) | TCCAGRTACAACGCCAGTATAGG | not provided |
| 121434332 | MAN2B1 | NM_000528.3(MAN2B1): c.1915C>T (p.Gln639Ter) | CCTGCTGCCTGTTCGCYAGACCT | Deficiency of alpha-mannosidase |
| 730880504 | MAP2K1 | NM_002755.3(MAP2K1): c.412G>A (p.Glu138Lys) | TGGCRAGATCAGTATCTGCATGG | Rasopathy |
| 63750635 | MAPT | NM_016835.4(MAPT): c.1910C>T (p.Ser637Phe) | CCTGAGCAAGGTGACCTYCAAGT | Pick disease, not provided |
| 587777718 | MARS | NM_004990.3(MARS): c.1852C>T (p.Arg618Cys) | CCCTGCTGACATCTGGYGCTTCT, CCTGCTGACATCTGGYGCTTCTA | Charcot-Marie-Tooth disease, CHARCOT-MARIE-TOOTH DISEASE, AXONAL, TYPE 2U |
| 794726870 | MARS2 | NM_138395.3(MARS2): c.424C>T (p.Arg142Trp) | CCGCACCACGGAGGCCYGGCACC | COMBINED OXIDATIVE PHOSPHORYLATION DEFICIENCY 25 |
| 794726869 | MARS2 | NM_138395.3(MARS2): c.550C>T (p.Gln184Ter) | CCGAGGCCAAGGTCACCYAGCA | COMBINED OXIDATIVE PHOSPHORYLATION DEFICIENCY 25 |
| 118203957 | MARVELD2 | NM_001038603.2 (MARVELD2):c.1498C>T (p.Arg500Ter) | CCACATCATTCGGAAAGCYGACA | Deafness, autosomal recessive 49 |
| 72558181 | MAT1A | NM_000429.2(MAT1A): c.791G>A (p.Arg264His) | CACTGGCCRTAAGATTATTGTGG | Methionine adenosyltransferase deficiency, autosomal dominant |
| 104893640 | MATN3 | NM_002381.4(MATN3): c.209G>A (p.Arg70His) | CCTGGCCRCGCCCGCGGTGCAGG | Multiple epiphyseal dysplasia 5, Multiple Epiphyseal Dysplasia, Dominant |
| 786203385 | MAX | NM_002382.4(MAX): c.295+1G>A | AAGRTGAGCACCCGAGCTCGTGG | Hereditary cancer-predisposing syndrome |
| 1800450 | MBL2 | NM_000242.2(MBL2): c.161G>A (p.Gly54Asp) | ATGRCACCAAGGGAGAAAAGGGG, GATGRCACCAAGGGAGAAAAGGG, TGATGRCACCAAGGGAGAAAAGG | Mannose-binding protein deficiency |
| 5030737 | MBL2 | NM_000242.2(MBL2): c.154C>T (p.Arg52Cys) | CCCAGGCAAAGATGGGYGTGATG, CCAGGCAAAGATGGGYGTGATGG | Mannose-binding protein deficiency |
| 121913557 | MC4R | NM_005912.2(MC4R): c.148G>A (p.Val50Met) | CCTGAGRTGTTTGTGACTCTGGG, TCCTGAGRTGTTTGTGACTCTGG | Obesity |
| 121913563 | MC4R | NM_005912.2(MC4R): c.523G>A (p.Ala175Thr) | TGGRCAGCTTGCACGGTTTCAGG | Obesity |
| 121913567 | MC4R | NM_005912.2(MC4R): c.656C>T (p.Ala219Val) | CCACATGTTCCTGATGGYCAGGC | Obesity |
| 199517715 | MCCC1 | NM_020166.4(MCCC1): c.137G>A (p.Gly46Glu) | CCTTGGTAATGTTTCTTYCTGTT | not provided |
| 387906286 | MCFD2 | NM_001171507.2(MCFD2): c.149+5G>A | TACRTATTCAGCCCGGGCTGTGG | Factor v and factor viii, combined deficiency of, 2 |
| 387906287 | MCFD2 | NM_001171507.2(MCFD2): c.309+1G>A | TAAGGAGRTAGGTCTGGCAGTGG | Factor v and factor viii, combined deficiency of, 2 |
| 28934906 | MECP2 | NM_004992.3(MECP2): c.473C>T (p.Thr158Met) | CCTAATGATTTTGACTTCAYGGT | Angelman syndrome, Rett disorder, Severe neonatal-onset encephalopathy with microcephaly, Autism, susceptibility to, X-linked 3, not provided |
| 61748425 | MECP2 | NM_004992.3(MECP2): c.508C>T (p.Gln170Ter) | CCCCTCCCGGCGAGAGYAGAAAC, CCCTCCCGGCGAGAGYAGAAACC, CCTCCCGGCGAGAGYAGAAACCA | Rett disorder |
| 61749729 | MECP2 | NM_004992.3(MECP2): c.622C>T (p.Gln208Ter) | CCACGTCAGAGGGTGTGYAGGTG | Rett disorder |
| 61749747 | MECP2 | NM_004992.3(MECP2): c.730C>T (p.Gln244Ter) | CCACCACATCCACCYAGGTCATG | Rett disorder, Mental retardation, X-linked, syndromic 13, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 61753965 | MECP2 | NM_004992.3(MECP2): c.1216C>T (p.Gln406Ter) | CCAGCCCCCTGAGCCCYAGGAC | Rett disorder, Mental retardation, X-linked, syndromic 13, not provided |
| 397515554 | MED12 | NM_005120.2(MED12): c.2873G>A (p.Gly958Glu) | CATGRGATGAACCGGTCCGATGG | FG syndrome |
| 145770066 | MED25 | NM_030973.3(MED25): c.1004C>T (p.Ala335Val) | CCCCCAGGACCCCTGGCGYCCC, CCCCAGGACCCCTGGCGYCCCC, CCCAGGACCCCTGGCGYCCCCA, CCAGGACCCCTGGCGYCCCCAA | Charcot-Marie-Tooth disease type 2B2, Charcot-Marie-Tooth disease, not provided |
| 796052724 | MEF2C | NM_002397.4(MEF2C): c.258G>A (p.Glu86=) | TGGARGTGAGAGAGCATGCGTGG | not provided |
| 796052733 | MEF2C | NM_002397.4(MEF2C): c.766C>T (p.Arg256Ter) | CCGTAAACCAGATCTCYGAGTTC | not provided |
| 587783747 | MEF2C | NM_002397.4(MEF2C): c.565C>T (p.Arg189Ter) | CCTGGTGTAACACATYGACCTCC | Mental retardation, stereotypic movements, epilepsy, and/or cerebral malformations |
| 104895085 | MEFV | NM_000243.2(MEFV): c.1958G>A (p.Arg653His) | CCGCCRTTACTGGGAGGTGGAGG, TGGCCGCCRTTACTGGGAGGTGG | Familial Mediterranean fever |
| 28940578 | MEFV | NM_000243.2(MEFV): c.2082G>A (p.Met694Ile) | GATRAAGGAAAATGAGTACCAGG | Familial Mediterranean fever, Familial mediterranean fever, autosomal dominant |
| 104895105 | MEFV | NM_000243.2(MEFV): c.1432C>T (p.His478Tyr) | CCTGGAGCAGCAAGAGYATTTCT | Familial Mediterranean fever, Familial mediterranean fever, autosomal dominant |
| 104894257 | MEN1 | NM_130799.2(MEN1): c.594G>A (p.Trp198Ter) | CTGRCACGGCAAGGGCAACGAGG | not provided |
| 104894264 | MEN1 | NM_000244.3(MEN1): c.1267G>A (p.Asp423Asn) | CTACVACGGCATCTGCAAATGGG, TCTACVACGGCATCTGCAAATGG | Multiple endocrine neoplasia, type 1 |
| 794728628 | MEN1 | NM_130799.2(MEN1): c.1186-1G>A | GTCCARGGCACCCAGAGCCAAGG | not provided |
| 386134249 | MEN1 | NM_000244.3(MEN1): c.1277G>A (p.Cys426Tyr) | GGCATCTRCAAATGGGAGGAGGG, CGGCATCTRCAAATGGGAGGAGG | Multiple endocrine neoplasia, type 1, not provided |
| 398124437 | MEN1 | NM_130799.2(MEN1): c.912+1G>A | AAGRTGGGGGCATCTAAGGAGGG, CAAGRTGGGGGCATCTAAGGAGG, CCACAAGRTGGGGGCATCTAAGG | not provided |
| 28931612 | MEN1 | NM_000244.3(MEN1): c.76G>A (p.Glu26Lys) | TGCTGCCDAGCTGGGCCGAGAGG | |
| 794728614 | MEN1 | NM_130799.2(MEN1): c.35C>T (p.Pro12Leu) | CCCAGAAGACGCTGTTCCYGCTG, CCAGAAGACGCTGTTCCYGCTGC | not provided |
| 794728620 | MEN1 | NM_130799.2(MEN1): c.652C>T (p.Arg218Trp) | CCGGTGTGGCTGAGYGGGTATTG | not provided |
| 794728631 | MEN1 | NM_130799.2(MEN1): c.1660C>T (p.Gln554Ter) | CCAGTGCTCACTTTCYAGAGTGA | not provided |
| 794728647 | MEN1 | NM_130799.2(MEN1): c.322C>T (p.Arg108Ter) | CCTGTCCCTCTATCCTYGAGAAG | not provided |
| 794728654 | MEN1 | NM_130799.2(MEN1): c.1324C>T (p.Gln442Ter) | CCACCTTTCTTGTGYAGTCCCTA | not provided |
| 119489105 | MERTK | NM_006343.2(MERTK): c.1951C>T (p.Arg651Ter) | CCACCCAAATGTCATTYGACTTC | Retinitis pigmentosa 38 |
| 587777646 | METTL23 | NM_001080510.4 (METTL23):c.397C>T (p.Gln133Ter) | CCAATTGTGGTCTACTTATYAAG | Mental retardation, autosomal recessive 44 |
| 727502791 | MFAP5 | NM_003480.3(MFAP5): c.472C>T | CCGTCGCTCCAATTACTTCYGAC | Aortic aneurysm, familial thoracic 9 |
| 28940291 | MFN2 | NM_014874.3(MFN2): c.281G>A (p.Arg94Gln) | GGCTCRGAGGCACATGAAAGTGG | Charcot-Marie-Tooth disease, type 2A2 |
| 28940294 | MFN2 | NM_014874.3(MFN2): c.839G>A (p.Arg280His) | GGAGCRTTGTACCAGCTTCCTGG | Charcot-Marie-Tooth disease, type 2A2 |
| 138382758 | MFN2 | NM_014874.3(MFN2): c.1403G>A (p.Arg468His) | CTGCACCRCCACATAGAGGAAGG | Charcot-Marie-Tooth disease, type 2A2, not specified |
| 119103266 | MFN2 | NM_014874.3(MFN2): c.617C>T (p.Thr206Ile) | CCTGGTATTGATGTCAYCACAG, CCTGGTATTGATGTCAYCACAGA | Hereditary motor and sensory neuropathy with optic atrophy |
| 387906991 | MFN2 | NM_014874.3(MFN2): c.1085C>T (p.Thr362Met) | CCAAGTTTGAGCAGCACAYGGTC | Charcot-Marie-Tooth disease, type 2A2 |
| 267607235 | MFSD8 | NM_152778.2(MFSD8): c.1235C>T (p.Pro412Leu) | CCTGGTGCCTCTACACCCYGGTG | Ceroid lipofuscinosis neuronal 7 |
| 104894446 | MGAT2 | NM_002408.3(MGAT2): c.869C>T (p.Ser290Phe) | CCTGAATGTGATGTTCTCTYCCT | Carbohydrate-deficient glycoprotein syndrome type II |
| 587776943 | MGME1 | NM_001310338.1(MGME1): c.456G>A (p.Trp152Ter) | GTGRAAACAGCGGATGATTCTGG | Mitochondrial DNA depletion syndrome 11 |
| 119486096 | MINPP1 | NM_004897.4(MINPP1): c.122C>T (p.Ser41Leu) | CCGAGGGACCCGGTGGCCTYGTC | Thyroid cancer, follicular |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 281797258 | MKKS | NM_170784.2(MKKS): c.250C>T (p.His84Tyr) | TGACACATRATTCTGTATGGAGG | McKusick Kaufman syndrome |
| 80358245 | MLC1 | NM_015166.3(MLC1): c.278C>T (p.Ser93Leu) | CCAGTGCATCCCCTYGGCAATTG | Megalencephalic leukoencephalopathy with subcortical cysts 1 |
| 121908341 | MLC1 | NM_015166.3(MLC1): c.839C>T (p.Ser280Leu) | CCTCTGGATATCTGTYATTCAGC | Megalencephalic leukoencephalopathy with subcortical cysts 1 |
| 63750604 | MLH1 | NM_000249.3(MLH1): c.1790G>A (p.Trp597Ter) | AGTGGCTRGACAGAGGAAGATGG | Hereditary Nonpolyposis Colorectal Neoplasms |
| 587779021 | MLH1 | NM_000249.3(MLH1): c.545G>A (p.Arg182Lys) | GCARGTACAGTCCAAAATCTGGG, GGCARGTACAGTCCAAAATCTGG | Hereditary Nonpolyposis Colorectal Neoplasms |
| 63749820 | MLH1 | NM_000249.3(MLH1): c.436C>T (p.Gln146Ter) | CCATGTGCTGGCAATYAAGGGAC | Hereditary Nonpolyposis Colorectal Neoplasms |
| 63749950 | MLH1 | NM_000249.3(MLH1): c.842C>T (p.Ala281Val) | CCATAGAAACAGTGTATGYAGCC | Hereditary Nonpolyposis Colorectal Neoplasms |
| 63750192 | MLH1 | NM_000249.3(MLH1): c.1624C>T (p.Gln542Ter) | CCTCAGTGGGCCTTGGCAYAGCA | Hereditary Nonpolyposis Colorectal Neoplasms |
| 63750726 | MLH1 | NM_000249.3(MLH1): c.1961C>T (p.Pro654Leu) | CCCCCTTTGGAGGGACTGCYTAT, CCCCTTTGGAGGGACTGCYTATC, CCCTTTGGAGGGACTGCYTATCT, CCTTTGGAGGGACTGCYTATCTT | Hereditary Nonpolyposis Colorectal Neoplasms |
| 63751109 | MLH1 | NM_000249.3(MLH1): c.131C>T (p.Ser44Phe) | CCAGTTTAGATGCAAAATYCACA | Hereditary Nonpolyposis Colorectal Neoplasms, Lynch syndrome II |
| 63751153 | MLH1 | NM_000249.3(MLH1): c.1225C>T (p.Gln409Ter) | CCCCTGTCCAGTCAGCCCYAGGC, CCCTGTCCAGTCAGCCCYAGGCC, CCTGTCCAGTCAGCCCYAGGCCA | Hereditary Nonpolyposis Colorectal Neoplasms |
| 63751310 | MLH1 | NM_000249.3(MLH1): c.1975C>T (p.Arg659Ter) | CCTATCTTCATTCTTYGACTAGC | Hereditary Nonpolyposis Colorectal Neoplasms, Hereditary cancer-predisposing syndrome, not provided |
| 587779058 | MLH1 | NM_000249.3(MLH1): c.982C>T (p.Gln328Ter) | CCTGGAGCGGGTGCAGYAGCACA | Hereditary Nonpolyposis Colorectal Neoplasms, Hereditary cancer-predisposing syndrome |
| 119473031 | MLPH | NM_024101.6(MLPH): c.103C>T (p.Arg35Trp) | CCGAAGGAAAGAAGAGGAAYGGC | Griscelli syndrome type 3 |
| 369296618 | MMAB | NM_052845.3(MMAB): c.700C>T (p.Gln234Ter) | CTCTTRATTCCCCTCCTTCATGG | Methylmalonic aciduria cblB type, not provided |
| 756414548 | MMAB | NM_052845.3(MMAB): c.569G>A (p.Arg190His) | CCGTCTCTCGGCCCGGYGGCACA | not provided |
| 796051996 | MMACHC | NM_015506.2(MMACHC): c.420G>A (p.Trp140Ter) | CATGRGGGAACCAGGTGAGAGGG, CCATGRGGGAACCAGGTGAGAGG | Methylmalonic acidemia with homocystinuria, not provided |
| 796051997 | MMACHC | NM_015506.2(MMACHC): c.600G>A (p.Trp200Ter) | CTGRCGTGATTGGACTTACCGGG, ACTGRCGTGATTGGACTTACCGG | not provided |
| 121912955 | MMP2 | NM_004530.5(MMP2): c.1210G>A (p.Glu404Lys) | CACRAGTTTGGCCACGCCATGGG, CCACRAGTTTGGCCACGCCATGG | Multicentric osteolysis, nodulosis and arthropathy |
| 104893969 | MOCS1 | NM_001075098.3(MOCS1): c.956G>A (p.Arg319Gln) | GCCTGCRAATACACAGCTGATGGG, CGCCTGCRAATACACAGCTGATGG | Molybdenum cofactor deficiency, complementation group A |
| 104893970 | MOCS1 | NM_001075098.3(MOCS1): c.217C>T (p.Arg73Trp) | CCGGCAGCACAGCTACCTGYGGA | Molybdenum cofactor deficiency, complementation group A |
| 387907237 | MPC1 | NM_016098.3(MPC1): c.289C>T (p.Arg97Trp) | CCAGCTCATCCAGGGAGGGYGGC | Mitochondrial pyruvate carrier deficiency |
| 104894489 | MPI | NM_002435.2(MPI): c.656G>A (p.Arg219Gln) | AAGCRGATCTCCCAGCAAGGTGG, GTGAAGCRGATCTCCCAGCAAGG | Congenital disorder of glycosylation type 1B |
| 104894494 | MPI | NM_002435.2(MPI): c.305C>T (p.Ser102Leu) | CCTCTTCAAAGTGCTCTYAGTTG | Congenital disorder of glycosylation type 1B |
| 121913611 | MPL | NM_005373.2(MPL): c.769C>T (p.Arg257Cys) | CCTACTGGCTGCAGCTGYGCAGC | Congenital amegakaryocytic thrombocytopenia |
| 28730837 | MPO | NM_000250.1(MPO): c.995C>T (p.Ala332Val) | CCGCAACCAGATCAACGYGCTCA | Myeloperoxidase deficiency |
| 121909721 | MPV17 | NM_002437.4(MPV17): c.149G>A (p.Arg50Gln) | GAGAGGCCRGACTCTGACCATGG | Navajo neurohepatopathy |
| 121909724 | MPV17 | NM_002437.4(MPV17): c.359G>A (p.Trp120Ter) | CAACTGGCCAAACTACAGCGGG, ACAACTGGCCAAACTACAGCGG | Navajo neurohepatopathy |
| 267607261 | MPV17 | NM_002437.4(MPV17): c.206G>A (p.Trp69Ter) | GCTRGTACAAGGTTTGGATCGG, AGGAGGCTRGTACAAGGTTTGG | Navajo neurohepatopathy |
| 267607258 | MPV17 | NM_002437.4(MPV17): c.293C>T (p.Pro98Leu) | CCCTAGGGGGCTTTGCCCYGTG, CCTAGGGGGCTTTGCCCYGTGT | Navajo neurohepatopathy, not provided |
| 121913588 | MPZ | NM_000530.6(MPZ): c.409G>A (p.Gly137Ser) | CATAGTGRGCAAGACCTCTCAGG | Charcot-Marie-Tooth disease type 1B |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121913600 | MPZ | NM_000530.6(MPZ): c.308G>A (p.Gly103Glu) | GGTAGRGGACCCTCGCTGGAAGG | Charcot-Marie-Tooth disease type 1B |
| 121913598 | MPZ | NM_000530.6(MPZ): c.131C>T (p.Ser44Phe) | CCATGGTGCTGTGGGCTYCCGGG | Charcot-Marie-Tooth disease type 21, Charcot-Marie-Tooth disease type 1B |
| 137852761 | MRE11A | NM_005591.3(MRE11A): c.1714C>T (p.Arg572Ter) | CCAACAAAGGAAGAGGCYGAGGA | Hereditary cancer-predisposing syndrome, Ataxia-telangiectasia-like disorder |
| 63750396 | MSH2 | NM_000251.2(MSH2): c.1035G>A (p.Trp345Ter) | GTGRATTAAGCAGCCTCTCATGG | Hereditary Nonpolyposis Colorectal Neoplasms, not provided |
| 63750466 | MSH2 | NM_000251.2(MSH2): c.4G>A (p.Ala2Thr) | CGACATGRCGGTGCAGCCGAAGG | Hereditary Nonpolyposis Colorectal Neoplasms, Hereditary cancer-predisposing syndrome, not specified, not provided |
| 63750624 | MSH2 | NM_000251.2(MSH2): c.484G>A (p.Gly162Arg) | ACAGGTTRGAGTTGGGTATGTGG | Hereditary Nonpolyposis Colorectal Neoplasms |
| 63749917 | MSH2 | NM_000251.2(MSH2): c.2446C>T (p.Gln816Ter) | CCTTAACTATGCTTTATYAGGTG | Hereditary Nonpolyposis Colorectal Neoplasms |
| 63750203 | MSH2 | NM_000251.2(MSH2): c.1885C>T (p.Gln629Ter) | CCATTTTGGAGAAAGGAYAAGGA | Hereditary Nonpolyposis Colorectal Neoplasms |
| 63750302 | MSH2 | NM_000251.2(MSH2): c.1183C>T (p.Gln395Ter) | CCGACTTGCCAAGAAGTTTYAAA | Hereditary Nonpolyposis Colorectal Neoplasms |
| 63750488 | MSH2 | NM_000251.2(MSH2): c.715C>T (p.Gln239Ter) | CCACAAAGACATTTATYAGGAC | Hereditary Nonpolyposis Colorectal Neoplasms |
| 63750951 | MSH2 | NM_000251.2(MSH2): c.181C>T (p.Gln61Ter) | CCGGGAGGTGTTCAAGACCYAGG | Hereditary Nonpolyposis Colorectal Neoplasms, not provided |
| 63751226 | MSH2 | NM_000251.2(MSH2): c.472C>T (p.Gln158Ter) | CCGCAGTTGATGGCYAGAGACAG | Hereditary Nonpolyposis Colorectal Neoplasms |
| 28929483 | MSH2 | NM_000251.2(MSH2): c.1865C>T (p.Pro622Leu) | CCTGTTCCATATGTACGACYAGC | Hereditary Nonpolyposis Colorectal Neoplasms, Lynch syndrome I |
| 146816935 | MSH6 | NM_000179.2(MSH6): c.892C>T (p.Arg298Ter) | CCCTGTCAAAGTTGCTYGAAAGC, CCTGTCAAAGTTGCTYGAAAGCG | Hereditary Nonpolyposis Colorectal Neoplasms, Hereditary cancer-predisposing syndrome, not provided |
| 63750563 | MSH6 | NM_000179.2(MSH6): c.3013C>T (p.Arg1005Ter) | CCAAGAAGGGCTGTAAAYGATAC | Hereditary Nonpolyposis Colorectal Neoplasms, not provided |
| 587779212 | MSH6 | NM_000179.2(MSH6): c.1483C>T (p.Arg495Ter) | CCAGAAATGATGGAGGCAYGATG | Hereditary Nonpolyposis Colorectal Neoplasms, Hereditary cancer-predisposing syndrome, not provided |
| 267606883 | MT-001 | m.6328C>T | CCCACCCTGGAGCCTYCGTAGAC, CCACCCTGGAGCCTYCGTAGACC | Cytochrome c oxidase i deficiency |
| 200613617 | MT-OO3 | m.9804G>A | TTTGTARCCACAGGCTTCCACGG | Leber optic atrophy |
| 267606611 | MT-OO3 | m.9438G>A | TCCAAAAARGCCTTCGATACGGG | Leber optic atrophy |
| 207459995 | MT-CYB | m.14985G>A | ATCCRCTACCTTCACGCCAATGG | Familial colorectal cancer |
| 199795644 | MT-CYB | m.14831G>A | ATCTCCRCATGATGAAACTTCGG | Leber optic atrophy |
| 397515612 | MT-ND1 | m.3376G>A | CTTACCRAACGAAAAATTCTAGG | Leber optic atrophy |
| 199476115 | MT-ND2 | m.5244G>A | AACCRGCTTTTTGCCCAAATGG, TAACCRGCTTTTTGCCCAAATGG | Leber optic atrophy |
| 121434457 | MT-TA | m.5650G>A | TAARCCTTACTAGACCAATGGG, CTAARCCCTTACTAGACCAATGGG | |
| 118203886 | MT-TF | m.611G>A | TACACTRAAAATGTTTAGACGG, ATACACTRAAAATGTTTAGACGG | Myoclonus with epilepsy with ragged red fibers |
| 199476130 | MT-TN | m.5703G>A | AGCTAARCACCCTAATCAACTGG | |
| 587777418 | MTFMT | NM_139242.3(MTFMT): c.878G>A (p.Ser293Asn) | CCAGCAAGGACTGAAYTGTTAAC | Combined oxidative phosphorylation deficiency 15 |
| 786204030 | MTHFR | NM_005957.4(MTHFR): c.1683G>A (p.Trp561Ter) | TCACTTGRGGCATCTTCCCTGGG, GTCACTTGRGGCATCTTCCCTGG | Homocysteinemia due to MTHFR deficiency |
| 786204023 | MTHFR | NM_005957.4(MTHFR): c.1088G>A (p.Arg363His) | AGATGTACRTCCCATCTTCTGGG | Homocysteinemia due to MTHFR deficiency |
| 45590836 | MTHFR | NM_005957.4(MTHFR): c.1743G>A (p.Met581Ile) | CTTCATRTTCTGGAAGGTAAAGG | Homocysteinemia due to MTHFR deficiency |
| 769381688 | MTHFR | NM_005957.4(MTHFR): c.379C>T (p.His127Tyr) | TCATGTRCAGGATGGTCTCCAGG | Homocysteinemia due to MTHFR deficiency |
| 786204009 | MTHFR | NM_005957.4(MTHFR): c.244C>T (p.Arg82Trp) | CCCCTACAGGTTTGACYGGATG, CCCCTACAGGTTTGACYGGATGG, CCCTACAGGTTTGACYGGATGGC, CCTACAGGTTTGACYGGATGGCA | Homocysteinemia due to MTHFR deficiency |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 786204021 | MTHFR | NM_005957.4(MTHFR): c.1042C>T (p.Pro348Ser) | CCCAGGCGTCCCCTAYCCTGGGC, CCAGGCGTCCCCTAYCCTGGGCT | Homocysteinemia due to MTHFR deficiency |
| 786204022 | MTHFR | NM_005957.4(MTHFR): c.1060C>T (p.His354Tyr) | CCCTGGGCTCTCAGCGCCYACCC, CCTGGGCTCTCAGCGCCYACCCC | Homocysteinemia due to MTHFR deficiency |
| 367585605 | MTHFR | NM_005957.4(MTHFR): c.1320G>A (p.Ser440=) | CCGGTTTGGTTCTCCYGAGAGGT | Homocysteinemia due to MTHFR deficiency |
| 777661576 | MTHFR | NM_005957.4(MTHFR): c.1753-18G>A | CCTACACACACATACCCCYGCAC | Homocysteinemia due to MTHFR deficiency |
| 776483190 | MTHFR | NM_005957.4(MTHFR): c.137G>A (p.Arg46Gln) | CCGCCTCATCTTCTCCYGGAGTC | Homocysteinemia due to MTHFR deficiency |
| 121434294 | MTHFR | NM_005957.4(MTHFR): c.547C>T (p.Arg183Ter) | CCTGGTGAAGCACATCYGAAGTG | Homocystinuria due to MTHFR deficiency |
| 121434296 | MTHFR | NM_005957.4(MTHFR): c.1129C>T (p.Arg377Cys) | CCAAAGAGTTACATCTACYGTAC | Homocystinuria due to MTHFR deficiency |
| 132630307 | MTM1 | NM_000252.2(MTM1): c.469G>A (p.Glu157Lys) | GAARAAAAGTTTAACGTGGATGG, AAATGAARAAAAGTTTAACGTGG | Severe X-linked myotubular myopathy |
| 587783778 | MTM1 | NM_000252.2(MTM1): c.1337G>A (p.Trp446Ter) | TGTGTRGCAAATGTCAAAACAGG | Severe X-linked myotubular myopathy |
| 587783779 | MTM1 | NM_000252.2(MTM1): c.1353+1G>A | AAAACAGRTAAGGAATATGAGGG, CAAAACAGRTAAGGAATATGAGG | Severe X-linked myotubular myopathy |
| 587783846 | MTM1 | NM_000252.2(MTM1): c.64-1G>A | TGTTTCTARACGTCTCGAGATGG | Severe X-linked myotubular myopathy |
| 587783832 | MTM1 | NM_000252.2(MTM1): c.535C>T (p.Pro179Ser) | CCTCACAGGGCTTGYCCAATCAC | Severe X-linked myotubular myopathy |
| 587783836 | MTM1 | NM_000252.2(MTM1): c.557C>T (p.Thr186Ile) | CCATTGGAGAATAAYTTTTATTA | Severe X-linked myotubular myopathy |
| 587783841 | MTM1 | NM_000252.2(MTM1): c.614C>T (p.Pro205Leu) | CCTGCTCTTTTGGTGGTTCYGTA | Severe X-linked myotubular myopathy |
| 587783845 | MTM1 | NM_000252.2(MTM1): c.637C>T (p.Leu213Phe) | CCTCAGATGATGACYTCCGGAGA | Severe X-linked myotubular myopathy |
| 137853061 | MTRR | NM_002454.2(MTRR): c.1459G>A (p.Gly487Arg) | GGAAGRGAGTATGTACAGGCTGG | Homocystinuria-Megaloblastic anemia due to defect in cobalamin metabolism, cblE complementation type |
| 121918248 | MUT | NM_000255.3(MUT): c.52C>T (p.Gln18Ter) | CCTCATTACCTGAGGYAGGTAAA | METHYLMALONIC ACIDURIA, mut(0) TYPE |
| 398123278 | MUT | NM_000255.3(MUT): c.91C>T (p.Arg31Ter) | CCAGGCTCATACAGCAAYGACTT | Methylmalonic aciduria due to methylmalonyl-CoA mutase deficiency, not provided |
| 36053993 | MUTYH | NM_001128425.1(MUTYH): c.1187G>A (p.Gly396Asp) | CAGRTCTGCTGGCAGGACTGTGG | MYH-associated polyposis, Hereditary cancer-predisposing syndrome, Endometrial carcinoma, Carcinoma of colon, not specified, not provided |
| 587781337 | MUTYH | NM_001128425.1(MUTYH): c.1186+1G>A | AACTCAGRTACCTGGATACTGGG, CAACTCAGRTACCTGGATACTGG | Hereditary cancer-predisposing syndrome |
| 748170941 | MUTYH | NM_001128425.1(MUTYH): c.309G>A (p.Trp103Ter) | CCCGTTTCTCTTGGTCGTAYCAG, CCGTTTCTCTTGGTCGTAYCAGC | MYH-associated polyposis, Hereditary cancer-predisposing syndrome |
| 140342925 | MUTYH | NM_001128425.1(MUTYH): c.734G>A (p.Arg245His) | CCAATGGCTCGGACAYGGCACAG | MYH-associated polyposis, Hereditary cancer-predisposing syndrome |
| 587780082 | MUTYH | NM_001128425.1(MUTYH): c.1012C>T (p.Gln338Ter) | CCCAGCTCCCAACACTGGAYAGT, CCAGCTCCCAACACTGGAYAGTG | Hereditary cancer-predisposing syndrome |
| 587781338 | MUTYH | NM_001128425.1(MUTYH): c.940C>T (p.Gln314Ter) | CCTCTCAGGTGGAGYAGGAACAG | Hereditary cancer-predisposing syndrome |
| 372267274 | MUTYH | NM_001128425.1(MUTYH): c.389-1G>A | CCTCTGAGACCCACAYTGGGGGA | Hereditary cancer-predisposing syndrome |
| 587783057 | MUTYH | NM_001128425.1(MUTYH): c.1171C>T (p.Gln391Ter) | CCCAAATTCTGCTGGTGYAGAGG, CCAAATTCTGCTGGTGYAGAGGC | Carcinoma of colon |
| 104895317 | MVK | NM_000431.3(MVK): c.1000G>A (p.Ala334Thr) | GGCRCAGGCGGTGGTGGCTGTGG | Hyperimmunoglobulin D with periodic fever, Mevalonic aciduria |
| 104895319 | MVK | NM_000431.3(MVK): c.928G>A (p.Val310Met) | CGGCRTGGGCCACGCCTCTCTGG | Hyperimmunoglobulin D with periodic fever, Mevalonic aciduria |
| 137852604 | MXI1 | NM_130439.3(MXI1): c.362C>T (p.Ala121Val) | CCACGGAGGTTGAGCGGGYACA | Neurofibrosarcoma |
| 36211723 | MYBPC3 | NM_000256.3(MYBPC3): c.2308G>A (p.Asp770Asn) | GTCATCRGTGAGGCCGGCCGGGG, GGTCATCRGTGAGGCCGGCCGGG, AGGTCATCRGTGAGGCCGGCCGG | Primary familial hypertrophic cardiomyopathy, Familial hypertrophic cardiomyopathy 4, Cardiomyopathy |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 727505266 | MYBPC3 | NM_000256.3(MYBPC3): c.1219G>A (p.Gly407Ser) | TGAGCRGCAGGTGCAGCCTGGGG, ATGAGCRGCAGGTGCAGCCTGGG, GATGAGCRGCAGGTGCAGCCTGG | Cardiomyopathy, not specified |
| 730880597 | MYBPC3 | NM_000256.3(MYBPC3): c.3641G>A (p.Trp1214Ter) | TTCCTRGTTCAAGAATGGCCTGG | Cardiomyopathy |
| 397515903 | MYBPC3 | NM_000256.3(MYBPC3): c.1458-1G>A | GGCTARGCTGAAGGACGGGGTGG, CCCGGCTARGCTGAAGGACGGGG | Familial hypertrophic cardiomyopathy 4, Cardiomyopathy |
| 397515935 | MYBPC3 | NM_000256.3(MYBPC3): c.1897+1G>A | TCATGGRTGAGCCTGCTCCAGGG, TTCATGGRTGAGCCTGCTCCAGG | Familial hypertrophic cardiomyopathy 4, Cardiomyopathy |
| 397515982 | MYBPC3 | NM_000256.3(MYBPC3): c.2670G>A (p.Trp890Ter) | GTGRCGGCCCCCAGAGCGCGTGG | Familial hypertrophic cardiomyopathy 4, Cardiomyopathy, Hypertrophic cardiomyopathy |
| 397516006 | MYBPC3 | NM_000256.3(MYBPC3): c.3233G>A (p.Trp1078Ter) | TGACGCCTRGGGTCTTAATGTGG | Familial hypertrophic cardiomyopathy 4 |
| 397516031 | MYBPC3 | NM_000256.3(MYBPC3): c.3627+1G>A | GCCCCAAGRTAGGGAACTTTAGG | Familial hypertrophic cardiomyopathy 4, Cardiomyopathy |
| 397516041 | MYBPC3 | NM_000256.3(MYBPC3): c.3797G>A (p.Cys1266Tyr) | GAGTRCCGCCTGGAGGTGCGAGG | Familial hypertrophic cardiomyopathy 4, Cardiomyopathy |
| 397516044 | MYBPC3 | NM_000256.3(MYBPC3): c.3815-1G>A | TCTGCARTGCCTCAGTGACCAGG | Familial hypertrophic cardiomyopathy 4, Cardiomyopathy |
| 397516074 | MYBPC3 | NM_000256.3(MYBPC3): c.772G>A (p.Glu258Lys) | TGTCCACRGTGAGGGGCCCTGG | Primary familial hypertrophic cardiomyopathy, Familial hypertrophic cardiomyopathy 4, Cardiomyopathy |
| 193922377 | MYBPC3 | NM_000256.3(MYBPC3): c.1321G>A (p.Glu441Lys) | GGGTGGCRAGAAGTGTAGCACGG | Primary familial hypertrophic cardiomyopathy, Cardiomyopathy, not specified |
| 727503167 | MYBPC3 | NM_000256.3(MYBPC3): c.3763G>A (p.Ala1255Thr) | TGCAGGRCCACCAACTTACAGGG, CTGCAGGRCCACCAACTTACAGG | Cardiomyopathy, not specified |
| 727503195 | MYBPC3 | NM_000256.3(MYBPC3): c.1790G>A (p.Arg597Gln) | GGGCRGTGAGTGTGCAGGGCAGG, CATCGGGCRGTGAGTGTGCAGGG | Familial hypertrophic cardiomyopathy 4, Cardiomyopathy, not specified |
| 727503204 | MYBPC3 | NM_000256.3(MYBPC3): c.1351+1G>A | AAAGRTGGGCCTGGGACCTGAGG | Familial hypertrophic cardiomyopathy 4 |
| 727503211 | MYBPC3 | NM_000256.3(MYBPC3): c.966G>A (p.Trp322Ter) | CGTGTGRGAGATCCTACGGCAGG | Familial hypertrophic cardiomyopathy 4 |
| 727504276 | MYBPC3 | NM_000256.3(MYBPC3): c.3335G>A (p.Trp1112Ter) | CCAGGAGTRGTTCACCGTCTTGG | Familial hypertrophic cardiomyopathy 4 |
| 727504305 | MYBPC3 | NM_000256.3(MYBPC3): c.3331-1G>A | CCARGAGTGGTTCACCGTCTTGG | Familial hypertrophic cardiomyopathy 4 |
| 727504334 | MYBPC3 | NM_000256.3(MYBPC3): c.2149-1G>A | CCARCTGCTGTGTGAGACCGAGG | Familial hypertrophic cardiomyopathy 4 |
| 727504349 | MYBPC3 | NM_000256.3(MYBPC3): c.2747G>A (p.Trp916Ter) | AGTRGGTGGCTGCCCTGCAGGGG, GAGTRGGTGGCTGCCCTGCAGGG, AGAGTRGGTGGCTGCCCTGCAGG | Familial hypertrophic cardiomyopathy 4 |
| 730880542 | MYBPC3 | NM_000256.3(MYBPC3): c.1457G>A (p.Trp486Ter) | AATRGTGAGTTCCAGAAGCACGG | Cardiomyopathy |
| 730880546 | MYBPC3 | NM_000256.3(MYBPC3): c.1731G>A (p.Trp577Ter) | TGTGTGRCTGAAGAATGGGAAGG | Cardiomyopathy |
| 730880576 | MYBPC3 | NM_000256.3(MYBPC3): c.2748G>A (p.Trp916Ter) | AGTRGRTGGCTGCCCTGCAGGGG, GAGTRGRTGGCTGCCCTGCAGGG, AGAGTRGRTGGCTGCCCTGCAGG | Cardiomyopathy |
| 730880584 | MYBPC3 | NM_000256.3(MYBPC3): c.2995-1G>A | TCARGGCAAGCCCCGGCCTCAGG | Cardiomyopathy |
| 730880639 | MYBPC3 | NM_000256.3(MYBPC3): c.1223+1G>A | GGCAGRTGCAGCCTGGGGTGGG, CGGCAGRTGCAGCCTGGGGTGGG, GCGGCAGRTGCAGCCTGGGGTGG | Cardiomyopathy |
| 730880691 | MYBPC3 | NM_000256.3(MYBPC3): c.1624+5G>A | CAGGGTGARCCTGGCTGGGGGGG | Cardiomyopathy |
| 373056282 | MYBPC3 | NM_000256.3(MYBPC3): c.2882C>T (p.Pro961Leu) | ACCRGCTCCGTGGTGGTAACAGG | Primary familial hypertrophic cardiomyopathy, Cardiomyopathy, not specified |
| 397515895 | MYBPC3 | NM_000256.3(MYBPC3): c.1273C>T (p.Gln425Ter) | CCCTGACCATCAGCYAGTGCTCA | Familial hypertrophic cardiomyopathy 4 |
| 397516005 | MYBPC3 | NM_000256.3(MYBPC3): c.3181C>T (p.Gln1061Ter) | CCACGCTGGTGCTGYAGGTTGTT | Primary familial hypertrophic cardiomyopathy, Familial hypertrophic cardiomyopathy 4, Cardiomyopathy |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397516037 | MYBPC3 | NM_000256.3(MYBPC3): c.3697C>T (p.Gln1233Ter) | CCGCATGTTCAGCAAGYAGGGAG | Familial hypertrophic cardiomyopathy 4, Cardiomyopathy, Hypertrophic cardiomyopathy |
| 397516061 | MYBPC3 | NM_000256.3(MYBPC3): c.613C>T (p.Gln205Ter) | CCTGAGCAGCAAGGTGGGCYAGC | Familial hypertrophic cardiomyopathy 4, Cardiomyopathy |
| 199865688 | MYBPC3 | NM_000256.3(MYBPC3): c.2497G>A (p.Ala833Thr) | CCCTCGATCATGCGCCGCGYTTC, CCTCGATCATGCGCCGCGYTTCA | Primary dilated cardiomyopathy, Primary familial hypertrophic cardiomyopathy, Familial hypertrophic cardiomyopathy 4, Left ventricular noncompaction 10, Cardiomyopathy, Paroxysmal atrial fibrillation, not specified |
| 200625851 | MYBPC3 | NM_000256.3(MYBPC3): c.1468G>A (p.Gly490Arg) | CCCGGGTCAGCTCCACCCYGTCC, CCGGGTCAGCTCCACCCYGTCCT | Primary familial hypertrophic cardiomyopathy, Familial hypertrophic cardiomyopathy 4, Left ventricular noncompaction 10, Cardiomyopathy, not specified |
| 727503216 | MYBPC3 | NM_000256.3(MYBPC3): c.557C>T (p.Pro186Leu) | CCAGCCTCCTGAAGCYGCCTGTG | Cardiomyopathy, not specified |
| 727504234 | MYBPC3 | NM_000256.3(MYBPC3): c.844C>T (p.Arg282Trp) | CCTGGCTGGAGGTGGTCGGYGGA | Familial hypertrophic cardiomyopathy 4, not specified |
| 730880544 | MYBPC3 | NM_000256.3(MYBPC3): c.1522C>T (p.Gln508Ter) | CCGGTTCAAGAAGGACGGGYAGA | Cardiomyopathy |
| 730880552 | MYBPC3 | NM_000256.3(MYBPC3): c.1822C>T (p.Pro608Ser) | CCATTGACGACGTCACAYCTGCC | Cardiomyopathy |
| 730880586 | MYBPC3 | NM_000256.3(MYBPC3): c.3034C>T (p.Gln1012Ter) | CCTGGACCAAAGAGGGGYAGCCC | Cardiomyopathy |
| 730880618 | MYBPC3 | NM_000256.3(MYBPC3): c.484C>T (p.Gln162Ter) | CCTCTTCGTGATGCGGCCAYAGG | Familial hypertrophic cardiomyopathy 4, Cardiomyopathy |
| 730880699 | MYBPC3 | NM_000256.3(MYBPC3): c.3553C>T (p.Gln1185Ter) | CCCCAAGCTTCACCYAGCCCCTG | Cardiomyopathy |
| 368765949 | MYBPC3 | NM_000256.3(MYBPC3): c.3642G>A (p.Trp1214Ter) | CCAGGCCATTCTTGAAYCAGGAA | Familial hypertrophic cardiomyopathy 4, Cardiomyopathy, not provided |
| 371488302 | MYBPC3 | NM_000256.3(MYBPC3): c.2311G>A (p.Val771Met) | CCGCAGGTGCGTCTGGCAYGTCT | Primary dilated cardiomyopathy, Primary familial hypertrophic cardiomyopathy, Cardiomyopathy |
| 387907267 | MYBPC3 | NM_000256.3(MYBPC3): c.2827C>T (p.Arg943Ter) | CCCGGCTGCTTTTCYGAGTGCGG | Familial hypertrophic cardiomyopathy 4, Cardiomyopathy |
| 104893646 | MYCN | NM_005378.5(MYCN): c.1178G>A (p.Arg393His) | GCCAGCRCCGCAACGACCTTCGG | Feingold syndrome 1 |
| 267606902 | MYH11 | NM_022844.2(MYH11): c.2135G>A (p.Arg712Gln) | GCCRGCAGGGCTTCCCCAACCGG | Aortic aneurysm, familial thoracic 4, Thoracic aortic aneurysms and aortic dissections |
| 28940306 | MYH14 | NM_001145809.1(MYH14): c.3049C>T (p.Leu1017Phe) | CCAGGAGCTAGAGGCCCACYTTG | Deafness, autosomal dominant 4 |
| 119103281 | MYH14 | NM_001145809.1(MYH14): c.359C>T (p.Ser120Leu) | CCTGCCTCAACGAGGCCTYGGTC, CCTCAACGAGGCCTYGGTCCTGC | Deafness, autosomal dominant 4 |
| 121913623 | MYH3 | NM_002470.3(MYH3): c.700G>A (p.Ala234Thr) | TTGGGAACRCCAAGACTGTGAGG | Distal arthrogryposis type 2B |
| 121913619 | MYH3 | NM_002470.3(MYH3): c.533C>T (p.Thr178Ile) | CCAGTCCATTCTGATCAYGTAAG | Freeman-Sheldon syndrome, Distal arthrogryposis type 2B |
| 36211715 | MYH7 | NM_000257.3(MYH7): 09G>A (p.Arg870His) | GGCTCGCCRCAAGGAGCTGGAGG | Primary familial hypertrophic cardiomyopathy, Familial hypertrophic cardiomyopathy 1, Cardiomyopathy |
| 45520836 | MYH7 | NM_000257.3(MYH7): c.5588G>A (p.Arg1863Gln) | CCTGCTGCRGCTGCAGGACCTGG | Cardiomyopathy, not specified |
| 372381770 | MYH7 | NM_000257.3(MYH7): c.5561C>T (p.Thr1854Met) | TCCTCCRTCTGGGGGCCAGAGGG, CTCCTCCRTCTGGGGGCCAGAGG | Primary familial hypertrophic cardiomyopathy, Cardiomyopathy, not specified |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 3218713 | MYH7 | NM_000257.3(MYH7): c.746G>A (p.Arg249Gln) | ATTCATTCRAATTCATTTTGGGG | Primary familial hypertrophic cardiomyopathy, Familial hypertrophic cardiomyopathy 1, Cardiomyopathy |
| 397516088 | MYH7 | NM_000257.3(MYH7): c.1063G>A (p.Ala355Thr) | ACAGGCRCCATCATGCACTTTGG | Cardiomyopathy, not specified |
| 397516097 | MYH7 | NM_000257.3(MYH7): c.1273G>A (p.Gly425Arg) | TGCCACTRGGGCACTGGCCAAGG | Primary familial hypertrophic cardiomyopathy, Cardiomyopathy |
| 397516101 | MYH7 | NM_000257.3(MYH7): c.1358G>A (p.Arg453His) | CAGCCACRCCAGTACTTCATAGG | Primary familial hypertrophic cardiomyopathy, Familial hypertrophic cardiomyopathy 1, Cardiomyopathy, Hypertrophic cardiomyopathy |
| 397516135 | MYH7 | NM_000257.3(MYH7): c.2168G>A (p.Arg723His) | GTATCRCATCCTGAACCCAGCGG | Familial cardiomyopathy, not specified |
| 397516202 | MYH7 | NM_000257.3(MYH7): c.4135G>A (p.Ala1379Thr) | GGACRCCATTCAGCGGACTGAGG | Primary familial hypertrophic cardiomyopathy, Familial hypertrophic cardiomyopathy 1, Cardiomyopathy |
| 397516241 | MYH7 | NM_000257.3(MYH7): c.5302G>A (p.Glu1768Lys) | AGAGRAGCTGAAGAAGGAGCAGG | Cardiomyopathy, not specified |
| 397516248 | MYH7 | NM_000257.3(MYH7): c.5401G>A (p.Glu1801Lys) | GCCRAGCAGATCGCCCTCAAGGG, AGCCRAGCAGATCGCCCTCAAGG | Myopathy, distal, 1, Familial hypertrophic cardiomyopathy 1, Cardiomyopathy |
| 730880870 | MYH7 | NM_000257.3(MYH7): c.1325G>A (p.Arg442His) | GACGCRCATCAATGCCACCCTGG | Cardiomyopathy |
| 121913628 | MYH7 | NM_000257.3(MYH7): c.2770G>A (p.Glu924Lys) | GAACRAGAGGCTGGAGGATGAGG | Primary familial hypertrophic cardiomyopathy, Familial hypertrophic cardiomyopathy 1, Cardiomyopathy, Hypertrophic cardiomyopathy |
| 121913638 | MYH7 | NM_000257.3(MYH7): c.2146G>A (p.Gly716Arg) | TCTACRGGGACTTCCGGCAGAGG | Primary familial hypertrophic cardiomyopathy, Familial hypertrophic cardiomyopathy 1, Cardiomyopathy, not specified |
| 121913641 | MYH7 | NM_000257.3(MYH7): c.2156G>A (p.Arg719Gln) | TCCRGCAGAGGTGGGTATGAGGG, TTCCRGCAGAGGTGGGTATGAGG | Primary familial hypertrophic cardiomyopathy, Familial hypertrophic cardiomyopathy 1, Cardiomyopathy |
| 121913645 | MYH7 | NM_000257.3(MYH7): c.667G>A (p.Ala223Thr) | CCAGRCCAACCCTGCTCTGGAGG, CATCCAGRCCAACCCTGCTCTGG | Dilated cardiomyopathy 15 |
| 727504274 | MYH7 | NM_000257.3(MYH7): c.3346G>A (p.Glu1116Lys) | ACGCATCRAGGAGCTGGAGGAGG | Primary familial hypertrophic cardiomyopathy, Familial hypertrophic cardiomyopathy 1, Cardiomyopathy |
| 730880156 | MYH7 | NM_000257.3(MYH7): c.532G>A (p.Gly178Arg) | ACAGCRGAGAATCCGGAGCAGGG, CACAGCRGAGAATCCGGAGCAGG | Cardiomyopathy, Left ventricular noncompaction cardiomyopathy |
| 267606909 | MYH7 | NM_000257.3(MYH7): c.5296G>A (p.Ala1766Thr) | GATGRCAGAGGAGCTGAAGAAGG | Left ventricular noncompaction 5 |
| 730880916 | MYH7 | NM_000257.3(MYH7): c.5254G>A (p.Glu1752Lys) | TGCTRAGGAGAAGGCCAAGAAGG | Cardiomyopathy |
| 730880903 | MYH7 | NM_000257.3(MYH7): c.3157C>T (p.Arg1053Trp) | CCTGGAGCGAGCGAAGYGGAAGC | Cardiomyopathy |
| 121913637 | MYH7 | NM_000257.3(MYH7): c.2155C>T (p.Arg719Trp) | CCTCTACGGGGACTTCYGGCAGA | Primary familial hypertrophic cardiomyopathy, Familial hypertrophic cardiomyopathy 1, Cardiomyopathy |
| 727503253 | MYH7 | NM_000257.3(MYH7): c.2710C>T (p.Arg904Cys) | CCTGGCAGATGCTGAGGAGYGCT | Dilated cardiomyopathy 15, Cardiomyopathy |
| 727503263 | MYH7 | NM_000257.3(MYH7): c.2011C>T (p.Arg671Cys) | CCCATCCCCACTTTGTAYGTTGT, CCATCCCCACTTTGTAYGTTGTA | Cardiomyopathy, not specified |
| 727504240 | MYH7 | NM_000257.3(MYH7): c.2080C>T (p.Arg694Cys) | CCTGGTCATGCACCAGCTGYGCT | Primary familial hypertrophic cardiomyopathy, Cardiomyopathy |
| 606231324 | MYH7 | NM_000257.3(MYH7): c.1573G>A (p.Glu525Lys) | CCAAAGAGGCACCTTCTYGATGA | Familial cardiomyopathy, Dilated cardiomyopathy 15, Left ventricular noncompaction cardiomyopathy |
| 730880817 | MYH7 | NM_000257.3(MYH7): c.5399C>T (p.Ala1800Val) | CCGGCTGGACGAAGYCGAGCAGA | Cardiomyopathy |
| 730880918 | MYH7 | NM_000257.3(MYH7): c.5786C>T (p.Thr1929Met) | CCGTGACATTGGCAYGAAGGTGG | Cardiomyopathy, not specified |
| 202141173 | MYH7 | NM_000257.3(MYH7): c.2606G>A (p.Arg869His) | CCTCCAGCTCCTTGCGGYGAGCC, CCAGCTCCTTGCGGYGAGCCTCG | Cardiomyopathy, not specified |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80338828 | MYH9 | NM_002473.5(MYH9): c.2114G>A (p.Arg705His) | GCCRCCAGGGCTTCCCCAACAGG | Deafness, autosomal dominant nonsyndromic sensorineural 17, MYH9 related disorders |
| 80338827 | MYH9 | NM_002473.5(MYH9): c.2105G>A (p.Arg702His) | GGCATCCRTATCTGCCGCCAGGG, GGGCATCCRTATCTGCCGCCAGG | Epstein syndrome, Fechtner syndrome, MYH9 related disorders |
| 80338834 | MYH9 | NM_002473.5(MYH9): c.5521G>A (p.Glu1841Lys) | TCGGACCRAGAAGAAGCTGAAGG | May-Hegglin anomaly, Fechtner syndrome, MYH9 related disorders |
| 121913657 | MYH9 | NM_002473.5(MYH9): c.287C>T (p.Ser96Leu) | CCTCAACGAAGCCTYGGTGCTGC | Epstein syndrome, MYH9 related disorders |
| 80338835 | MYH9 | NM_002473.5(MYH9): c.5797C>T (p.Arg1933Ter) | CCGTTTGTCGTGCCCCGCYGAAT | May-Hegglin anomaly, Fechtner syndrome, Sebastian syndrome, MYH9 related disorders |
| 397516406 | MYL2 | NM_000432.3(MYL2): c.485G>A (p.Gly162Glu) | CCACGRAGAAGAGAAGGACTAGG | Familial hypertrophic cardiomyopathy 10, Cardiomyopathy |
| 199474814 | MYL2 | NM_000432.3(MYL2): c.484G>A (p.Gly162Arg) | CCACRGAGAAGAGAAGGACTAGG | Cardiomyopathy, not specified, not provided |
| 727503309 | MYO15A | NM_016239.3(MYO15A): c.5531+1G>A | ATCGACAGRTATCTTGGTTACGG | Deafness, autosomal recessive 3 |
| 201978571 | MYO15A | NM_016239.3(MYO15A): c.6046+1G>A | CAGRTGGGTCAGCACCAGGCGGG, GCAGRTGGGTCAGCACCAGGCGG, GTGGCAGRTGGGTCAGCACCAGG | Deafness, autosomal recessive 3 |
| 727503316 | MYO15A | NM_016239.3(MYO15A): c.7893+1G>A | CCAGRTGAGGGGGAAGGTGGGG, CCCAGRTGAGGGGGGAAGGTGGG, ACCCAGRTGAGGGGGGAAGGTGG | Deafness, autosomal recessive 3 |
| 121908104 | MYO5B | NM_001080467.2(MYO5B): c.1125G>A (p.Trp375Ter) | CTGRCTGTGTCATCGCAAGCTGG | Congenital microvillous atrophy |
| 121908106 | MYO5B | NM_001080467.2(MYO5B): c.1979C>T (p.Pro660Leu) | CCGCTGCATCAAGCYCAACGATG | Congenital microvillous atrophy |
| 121965082 | MYO7A | NM_000260.3(MYO7A): c.1797G>A (p.Met599Ile) | TCGCCATRGTAAGCCGGGTGCGG | Deafness, autosomal recessive 2, Usher syndrome, type 1B |
| 397516283 | MYO7A | NM_000260.3(MYO7A): c.1200+1G>A | AAAGRTGGGCTGGAGGGAAGGGG, TAAAGRTGGGCTGGAGGGAAGGG, GTAAAGRTGGGCTGGAGGGAAGG | Usher syndrome, type 1 |
| 111033178 | MYO7A | NM_000260.3(MYO7A): c.3719G>A (p.Arg1240Gln) | CACRGACACAGCCGCCCAGCTGG | Usher syndrome, type 1 |
| 387906700 | MYO7A | NM_000260.3(MYO7A): c.1184G>A (p.Arg395His) | CGTGCRCGACGCCTTCGTAAAGG | Deafness, autosomal recessive 2 |
| 121965080 | MYO7A | NM_000260.3(MYO7A): c.634C>T (p.Arg212Cys) | CCGCAATGACAACTCAAGCYGTT | Usher syndrome, type 1B |
| 773844428 | MYO7A | NM_000260.3(MYO7A): c.5968C>T (p.Gln1990Ter) | CCCTCACTCACCTACYAGGTGTT, CCTCACTCACCTACYAGGTGTTC | Usher syndrome, type 1 |
| 397516291 | MYO7A | NM_000260.3(MYO7A): c.1963C>T (p.Gln655Ter) | CCGGCACCTGTGCGTGCGCYAGC | Usher syndrome, type 1 |
| 397516321 | MYO7A | NM_000260.3(MYO7A): c.5617C>T (p.Arg1873Trp) | CCATCGACTGCCTGCAAYGGCTC | Usher syndrome, type 1 |
| 111033180 | MYO7A | NM_000260.3(MYO7A): c.1900C>T (p.Arg634Ter) | CCAGCCCTTCTTTGTGYGATGCA | Usher syndrome, type 1 |
| 111033182 | MYO7A | NM_000260.3(MYO7A): c.5101C>T (p.Arg1701Ter) | CCGGCTCTTGCAGCTGYGAACGG | Usher syndrome, type 1 |
| 199606180 | MYO7A | NM_000260.3(MYO7A): c.5660C>T (p.Pro1887Leu) | CCCGGAAGTACCCTCYGCACCTG, CCGGAAGTACCCTCYGCACCTGG | Usher syndrome, type 1 |
| 74315340 | MYOC | NM_000261.1(MYOC): c.734G>A (p.Cys245Tyr) | AGGATRTGGAGAACTAGTTTGGG, CAGGATRTGGAGAACTAGTTTGG | Primary open angle glaucoma juvenile onset 1 |
| 74315330 | MYOC | NM_000261.1(MYOC): c.1109C>T (p.Pro370Leu) | CCACGGACAGTTCCYGTATTCTT | Primary open angle glaucoma juvenile onset 1 |
| 121908461 | MYOT | NM_006790.2(MYOT): c.116C>T (p.Ser39Phe) | CCAGACCAAACAGTCTTYCATTA | Spheroid body myopathy |
| 71584501 | MYPN | NM_032578.3(MYPN): c.3263G>A (p.Arg1088His) | TGAGGGGCRCCTCTGTCGGCTGG | Dilated cardiomyopathy 1KK, not provided |
| 587777772 | NADK2 | NM_001287341.1(NADK2): c.595C>T (p.Arg199Ter) | TGTCRTTTTGCTGTTGAAAAAGG | 2,4-Dienoyl-CoA reductase deficiency |
| 121434529 | NAGA | NM_000262.2(NAGA): c.973G>A (p.Glu325Lys) | CTCTCATCRAAGTGTACATGCGG | Schindler disease, type 1 |
| 121434533 | NAGA | NM_000262.2(NAGA): c.986G>A (p.Arg329Gln) | CATGCRGCCTCTGTCCAACAAGG | Kanzaki disease |
| 104894590 | NAGLU | NM_000263.3(NAGLU): c.2021G>A (p.Arg674His) | CCCTCRCTGGCGGCTTTTCCTGG | Mucopolysaccharidosis, MPS-III-B, not provided |
| 104894593 | NAGLU | NM_000263.3(NAGLU): c.1928G>A (p.Arg643His) | GCCRCTACCAGCTGACCTTGTGG | Mucopolysaccharidosis, MPS-III-B |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 398123281 | NAGLU | NM_000263.3(NAGLU): c.503G>A (p.Trp168Ter) | ACTGGCCTRGAGCGGCCAGGAGG | not provided |
| 104894595 | NAGLU | NM_000263.3(NAGLU): c.1562C>T (p.Pro521Leu) | CCCGCTGGTCAGGCGGCYGTCCC, CCGCTGGTCAGGCGGCYGTCCCT | Mucopolysaccharidosis, MPS-III-B |
| 104894596 | NAGLU | NM_000263.3(NAGLU): c.1444C>T (p.Arg482Trp) | CCAGCTTTGCCGCCCGGYGGTAT | Mucopolysaccharidosis, MPS-III-B |
| 104894597 | NAGLU | NM_000263.3(NAGLU): c.1693C>T (p.Arg565Trp) | CCTGCTGGACCTCACTYGGCAGG | Mucopolysaccharidosis, MPS-III-B |
| 104894601 | NAGLU | NM_000263.3(NAGLU): c.700C>T (p.Arg234Cys) | CCGGGTCCTGGACCAGATGYGCT | Mucopolysaccharidosis, MPS-III-B |
| 786203986 | NALCN | NM_052867.2(NALCN): c.1768C>T (p.Leu590Phe) | CCATTTTATAGATCYTCCTGAGT | CONGENITAL CONTRACTURES OF THE LIMBS AND FACE, HYPOTONIA, AND DEVELOPMENTAL DELAY |
| 4987076 | NAT1 | NM_001160179.2(NAT1): c.445G>A (p.Val149Ile) | GCCTTGTRTCTTCCGTTTGACGG | |
| 387907112 | NBEAL2 | NM_015175.2(NBEAL2): c.2701C>T (p.Arg901Ter) | CCTGCTGCCCCTGCTGGAGYGAG | Gray platelet syndrome |
| 786204181 | NBN | NM_002485.4(NBN): c.2165G>A (p.Trp722Ter) | AGAGTRGCTAAGGCAGGAAATGG | Microcephaly, normal intelligence and immunodeficiency |
| 767215758 | NBN | NM_002485.4(NBN): c.1030C>T (p.Gln344Ter) | CCTTRTGAAAGGCTTGGTCCTGG | Microcephaly, normal intelligence and immunodeficiency |
| 119103271 | NCF1 | NM_000265.5(NCF1): c.271C>T (p.Gln91Ter) | CCGCCGAGAACCGCYAGGGCACA | Chronic granulomatous disease, autosomal recessive cytochrome b-positive, type 1 |
| 374402066 | NCF2 | NM_000433.3(NCF2): c.304C>T (p.Arg102Ter) | GTTCCCTCRAAGCTGAATCAAGG | Chronic granulomatous disease, autosomal recessive cytochrome b-positive, type 2 |
| 796065032 | NCF2 | NM_000433.3(NCF2): c.366+1G>A | GAGRTAAGGAGAACAGGGCCTGG, CCTGTGAGRTAAGGAGAACAGGG | Chronic granulomatous disease, autosomal recessive cytochrome b-positive, type 2 |
| 398123577 | NDE1 | NM_001143979.1(NDE1): c.704-1G>A | CCARGCCTGGACGACTCCACCGG | not provided |
| 104894883 | NDP | NM_000266.3(NDP): c.302C>T (p.Ser101Phe) | CCGGCCCCAGACTTYCAAGCTGA | Atrophia bulborum hereditaria |
| 28933684 | NDP | NM_000266.3(NDP): c.370C>T (p.Leu124Phe) | CCACCTACCGGTACATCYTCTCC, CCTACCGGTACATCYTCTCCTGT | Familial exudative vitreoretinopathy, X-linked |
| 119483085 | NDRG1 | NM_001135242.1(NDRG1): c.442C>T (p.Arg148Ter) | CCTACATCCTAACTYGATTTGCT | Charcot-Marie-Tooth disease, type 4D |
| 606231459 | NDST1 | NM_001543.4(NDST1):1 c.1831G>A (p.Gly611Ser) | ATCATCRGCCCCAGAAAACAGG | Mental retardation, autosomal recessive 46 |
| 199422225 | NDUFS1 | NM_005006.6(NDUFS1): c.721C>T (p.Arg241Trp) | CCCTATGCCTTTACTGCCYGGCC, CCTATGCCTTTACTGCCYGGCCT | Mitochondrial complex I deficiency |
| 104893899 | NDUFS4 | NM_002495.2(NDUFS4): c.44G>A (p.Trp15Ter) | GTTGTRGCGGAGAAGGGCAGTGG | Mitochondrial complex I deficiency |
| 121434479 | NDUFS7 | NM_024407.4(NDUFS7): c.434G>A (p.Arg145His) | CGCRCTACGTGGTCTCCATGGGG, CCGCRCTACGTGGTCTCCATGGG, GCCGCRCTACGTGGTCTCCATG | Leigh syndrome due to mitochondrial complex I deficiency |
| 121912638 | NDUFS8 | NM_002496.3(NDUFS8): c.305G>A (p.Arg102His) | GCTGCRCCGGTACCCATCCGGGG, CGCTGCRCCGGTACCCATCCGGG, GCGCTGCRCCGGTACCCATCCGG | Mitochondrial complex I deficiency |
| 28939679 | NDUFS8 | NM_002496.3(NDUFS8): c.236C>T (p.Pro79Leu) | CCTGTTCCGGGAACYGGCCACCA | Mitochondrial complex I deficiency |
| 121912639 | NDUFS8 | NM_002496.3(NDUFS8): c.254C>T (p.Pro85Leu) | CCGGCCACCATCAACTACCYGTT, CCACCATCAACTACCYGTTCGAG | Mitochondrial complex I deficiency |
| 59101996 | NEFL | NM_006158.4(NEFL): c.446C>T (p.Ala149Val) | CCGCGACCTGCGCCTGGYGGCGG | Charcot-Marie-Tooth disease, type 1F, not provided |
| 104893983 | NEU1 | NM_000434.3(NEU1): c.727G>A (p.Gly243Arg) | CGCTACRGAAGTGGGGTCAGCGG | Sialidosis type I, not provided |
| 104893986 | NEU1 | NM_000434.3(NEU1): c.69G>A (p.Trp23Ter) | CTGRGGAGGCTGTAGGGTTTGGG, TCTGRGGAGGCTGTAGGGTTTGG | Sialidosis, type II |
| 28940583 | NEU1 | NM_000434.3(NEU1): c.649G>A (p.Val217Met) | GCCTCATCRTGTGTGGCCATGGG | Sialidosis type I |
| 104893981 | NEU1 | NM_000434.3(NEU1): c.893C>T (p.Ala298Val) | CCTCCGCAGCTATGATGYCTGTG, CCGCAGCTATGATGYCTGTGATA | Sialidosis, type II |
| 104893979 | NEU1 | NM_000434.3(NEU1): c.946C>T (p.Pro316Ser) | CCCTGAGCTCGTGGACYCTGTGG, CCTGAGCTCGTGGACYCTGTGGT | Sialidosis type I |
| 786203443 | NF1 | NM_001042492.2(NF1): c.8095C>T (p.Gln2699Ter) | CCCCACCACAATACYAAACATCT | Hereditary cancer-predisposing syndrome |
| 786203448 | NF1 | NM_001042492.2(NF1): c.625C>T (p.Gln209Ter) | CCCTAAAGAAGGTTGCGYAGTTA, CCTAAAGAAGGTTGCGYAGTTAG | Hereditary cancer-predisposing syndrome |
| 768638173 | NF1 | NM_000267.3(NF1): c.2041C>T (p.Arg681Ter) | CCCCCCCGATTTGCYGACAAGCC | Neurofibromatosis, type 1 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137854559 | NF1 | NM_000267.3(NF1): c.4021C>T (p.Gln1341Ter) | CCAGCGGAACCTCCTTYAGATGA | Neurofibromatosis, type 1 |
| 121434259 | NF2 | NM_000268.3(NF2): c.169C>T (p.Arg57Ter) | CCGGACTCTGGGGCTCYGAGAAA | Meningioma |
| 74315501 | NF2 | NM_000268.3(NF2): c.1219C>T (p.Gln407Ter) | CCGCAGAGGCTGAGYAGGAAATG | Neurofibromatosis, type 2 |
| 74315496 | NF2 | NM_000268.3(NF2): c.784C>T (p.Arg262Ter) | CCCGTGGAATGAAATCYGAAACA, CCGTGGAATGAAATCYGAAACAT | Neurofibromatosis, type 2 |
| 387907253 | NFIX | NM_002501.3(NFIX): c.568C>T (p.Gln190Ter) | CCTGCAGAATCCGAYAATCAGA | Sotos syndrome 2 |
| 118204453 | NHEJ1 | NM_024782.2(NHEJ1): c.532C>T (p.Arg178Ter) | CCTTCTTATTACAGATYGATTGA | Severe combined immunodeficiency with microcephaly, growth retardation, and sensitivity to ionizing radiation |
| 104894881 | NHS | NM_198270.3(NHS): c.115C>T (p.Gln39Ter) | CCGCCGCCGCCCTTGYAGCCGCC | Nance-Horan syndrome |
| 587784027 | NIPBL | NM_133433.3(NIPBL): c.6954+1G>A | GTTCAGRTAAGCATGTTTTATGG | Cornelia de Lange syndrome 1 |
| 80358367 | NIPBL | NM_015384.4(NIPBL): c.133C>T (p.Arg45Ter) | CCTTCTCTTTAATGCAYGAATAG | Cornelia de Lange syndrome 1 |
| 587783901 | NIPBL | NM_133433.3(NIPBL): c.2389C>T (p.Arg797Ter) | CCTCGGTTAAAATCAGAAYGAGC | Cornelia de Lange syndrome 1 |
| 587784062 | NIPBL | NM_133433.3(NIPBL): c.892C>T (p.Gln298Ter) | CCACCTTTAATCCTAYAATCTCA | Cornelia de Lange syndrome 1 |
| 587784065 | NIPBL | NM_133433.3(NIPBL): c.922C>T (p.Arg308Ter) | CCTTGTTCATCACCTYGAGATGT | Cornelia de Lange syndrome 1 |
| 137852694 | NKX2-1 | NM_001079668.2(NKX2-1): c.745C>T (p.Gln249Ter) | CCGCTACAAAATGAAGCGCYAGG | Benign hereditary chorea |
| 28936670 | NKX2-5 | NM_004387.3(NKX2-5): c.73C>T (p.Arg25Cys) | CCTGGAACAGCAGCAGYGCAGCC | Tetralogy of Fallot, Congenital heart disease, Interrupted aortic arch, Hypothyroidism, congenital, nongoitrous, 5, Hypoplastic left heart syndrome 2, Truncus arteriosus, not specified, Malformation of the heart and great vessels, not provided |
| 104893900 | NKX2-5 | NM_004387.3(NKX2-5): c.533C>T (p.Thr178Met) | CCAGCGTGCTGAAACTCAYGTCC | Atrial septal defect 7 with or without atrioventricular conduction defects |
| 104893901 | NKX2-5 | NM_004387.3(NKX2-5): c.508C>T (p.Gln170Ter) | CCCCCGAACGCGACYAGCTGGCC | Atrial septal defect 7 with or without atrioventricular conduction defects |
| 104893902 | NKX2-5 | NM_004387.3(NKX2-5): c.656C>T (p.Ala219Val) | CCGCCTGCCCGCAGGATCGYGGT, CCTGCCCGCAGGATCGYGGTGCC | Tetralogy of Fallot |
| 104893905 | NKX2-5 | NM_004387.3(NKX2-5): c.646C>T (p.Arg216Cys) | CCGCCGCCGCCGCCTGCCYGCAG, CCGCCGCCGCCTGCCYGCAGGAT | Tetralogy of Fallot |
| 104895564 | NLRP12 | NM_144687.3(NLRP12): c.850C>T (p.Arg284Ter) | CCTCTCCAGGAGCTCATCYGAGT | Familial cold autoinflammatory syndrome 2, not provided |
| 121908146 | NLRP3 | NM_001243133.1(NLRP3): c.1316C>T (p.Ala439Val) | CCAAGACCACCACCGYGGTGTAC | Familial cold urticaria |
| 121908149 | NLRP3 | NM_001243133.1(NLRP3): c.1055C>T (p.Ala352Val) | CCACGAGACCTGTGGYCCTGGAG | Familial amyloid nephropathy with urticaria AND deafness, Familial cold urticaria |
| 150726175 | NMNAT1 | NM_022787.3(NMNAT1): c.769G>A (p.Glu257Lys) | ACAGCTCTRAGAGTGAAGACAGG | Leber congenital amaurosis 9 |
| 387907294 | NMNAT1 | NM_022787.3(NMNAT1): c.25G>A (p.Val9Met) | GAARTGGTTCTCCTTGCTTGTGG | Leber congenital amaurosis 9 |
| 193303102 | NOBOX | NM_001080413.3(NOBOX): c.907C>T (p.Arg303Ter) | CCTGACAGTGATAAACGCYGAGA | Premature ovarian failure 5 |
| 104895461 | NOD2 | NM_022162.2(NOD2): c.1001G>A (p.Arg334Gln) | CTGCCRGCAGCTGCAGTGCATGG | Sarcoidosis, early-onset, Blau syndrome |
| 104895460 | NOD2 | NM_022162.2(NOD2): c.1405C>T (p.Leu469Phe) | CCCGGGGTGGCGGACCGCYTCAT, CCGGGGTGGCGGACCGCYTCATC | Sarcoidosis, early-onset, Blau syndrome |
| 121909283 | NODAL | NM_018055.4(NODAL): c.778G>A (p.Gly260Arg) | ACCTGATCRGATGGGCTCCTGG | Visceral heterotaxy 5, autosomal |
| 104894612 | NOG | NM_005450.4(NOG): c.551G>A (p.Cys184Tyr) | CGCTCGTRCTCCGTGCCCAGGG, GCGCTCGTRCTCCGTGCCCAGG | Cushing symphalangism |
| 587777734 | NOTCH1 | NM_017617.3(NOTCH1): c.5965G>A (p.Asp1989Asn) | CCATCATGCATGCGGGCATYCAG | Adams-Oliver syndrome 5 |
| 312262797 | NOTCH2 | NM_024408.3(NOTCH2): c.5858G>A (p.Arg1953His) | GCTGCCRCCTGGCTGTGGAGGG, GGCTGCCCRCCTGGCTGTGGAGG | Alagille syndrome 2 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 111033632 | NOTCH2 | NM_024408.3(NOTCH2): c.1331G>A (p.Cys444Tyr) | GAGTRTCTGAAGGGTTATGCAGG | Alagille syndrome 2 |
| 312262796 | NOTCH2 | NM_024408.3(NOTCH2): c.5857C>T (p.Arg1953Cys) | CCCCTGATCCTGGCTGCCYGCCT, CCCTGATCCTGGCTGCCYGCCTG, CCTGATCCTGGCTGCCYGCCTGG | Alagille syndrome 2 |
| 387906747 | NOTCH2 | NM_024408.3(NOTCH2): c.6949C>T (p.Gln2317Ter) | CCCTAAAGGCAGTATTGCCYAAC, CCTAAAGGCAGTATTGCCYAACC | Hajdu-Cheney syndrome |
| 387906749 | NOTCH2 | NM_024408.3(NOTCH2): c.7165C>T (p.Gln2389Ter) | CCCCACACCCCCTTCAYAGCACA, CCCACACCCCCTTCAYAGCACAG, CCACACCCCCTTCAYAGCACAGT | Hajdu-Cheney syndrome |
| 28933696 | NOTCH3 | NM_000435.2(NOTCH3): c.505C>T (p.Arg169Cys) | CCGGGTGGGTGAGCCCTGCYGCC | Cerebral autosomal dominant arteriopathy with subcortical infarcts and leukoencephalopathy |
| 137852641 | NOTCH3 | NM_000435.2(NOTCH3): c.994C>T (p.Arg332Cys) | CCACCTGCCATGACYGCGTGGCT | Cerebral autosomal dominant arteriopathy with subcortical infarcts and leukoencephalopathy |
| 120074130 | NPC1 | NM_000271.4(NPC1): c.2665G>A (p.Val889Met) | GCCRTGTACTTTGTCCTGGAGG, TCCGCCRTGTACTTTGTCCTGG | NIEMANN-PICK DISEASE, TYPE C1, ADULT FORM |
| 483352891 | NPC1 | NM_000271.4(NPC1): c.2366G>A (p.Arg789His) | TTAAACRTCAAGAGGTAAGTTGG | Niemann-Pick disease type C1 |
| 104894458 | NPC2 | NM_006432.3(NPC2): c.358C>T (p.Pro120Ser) | CCAGTGAAAAGCGAATATYCCTC | Niemann-Pick disease type C2 |
| 140130028 | NPC2 | NM_006432.3(NPC2): c.441+1G>A | CCCCCAGATAGACTTAYGATCTG, CCCCAGATAGACTTAYGATCTGT, CCCAGATAGACTTAYGATCTGTA | Niemann-Pick disease type C2, not provided |
| 137852920 | NPHP4 | NM_015102.4(NPHP4): c.2044C>T (p.Arg682Ter) | CCCACCCGCAACGACGCCAYGAC, CCACCCGCAACGACGCCAYGACT, CCCGCAACGACGCCAYGACTGCA, CCGCAACGACGCCAYGACTGCAG | Nephronophthisis 4, Infertility, Cerebello-oculo-renal syndrome (nephronophthisis, oculomotor apraxia and cerebellar abnormalities) |
| 137852922 | NPHP4 | NM_015102.4(NPHP4): c.2335C>T (p.Gln779Ter) | CCAAGGCCGGCCGGCTGTYAGG | Senior-Loken syndrome 4 |
| 28939695 | NPHS1 | NM_004646.3(NPHS1): c.1339G>A (p.Glu447Lys) | TGGATTRAGGGTCCCCCAGAGGG, GTGGATTRAGGGTCCCCCAGAGG | Proteinuria, Finnish congenital nephrotic syndrome, not specified |
| 758478717 | NPR2 | NM_003995.3(NPR2): c.328C>T (p.Arg110Cys) | CCCTGCTGCCTCTGTGGCCYGCT, CCTGCTGCCTCTGTGGCCYGCTT | SHORT STATURE WITH NONSPECIFIC SKELETAL ABNORMALITIES |
| 104894889 | NROB1 | NM_000475.4(NROB1): c.704G>A (p.Trp235Ter) | CCCTRGTGGGACACCTCCTCTGG | Congenital adrenal hypoplasia, X-linked |
| 104894894 | NROB1 | 183CNM_000475.4(NROB1): c.1>T (p.Gln395Ter) | CCAGACGTGCCGGGCCTGYAGTG | Congenital adrenal hypoplasia, X-linked |
| 28937873 | NR2E3 | NM_014249.3(NR2E3): c.932G>A (p.Arg311Gln) | TCGGTTCCRGGCATTGGCGGTGG | Goldmann-Favre syndrome, Enhanced s-cone syndrome, not provided |
| 104894493 | NR2E3 | NM_014249.3(NR2E3): c.227G>A (p.Arg76Gln) | TACRGCGGAGGCTCATCTACAGG | Enhanced s-cone syndrome |
| 6189 | NR3C1 | NM_000176.2(NR3C1): c.66G>A (p.Glu22=) | TCAGGARAGGGGAGATGTGATGG | |
| 121912566 | NR3C2 | NM_000901.4(NR3C2): c.1897G>A (p.Gly633Arg) | TGGAARGTAAATGTTCATGTGGG, GTGGAARGTAAATGTTCATGTGG | Pseudohypoaldosteronism type 1 autosohymal dominant |
| 121912573 | NR3C2 | NM_000901.4(NR3C2): c.2453C>T (p.Ser818Leu) | CCTTGAGCTGGAGATYGTACAAA | Pseudohypoaldosteronism type 1 autosohymal dominant |
| 104894124 | NR5A1 | NM_004959.4(NR5A1): c.43G>A (p.Val15Met) | GTGCCCCRTGTGCGGGGACAAGG | 46,XY sex reversal, type 3 |
| 104894126 | NR5A1 | NM_004959.4(NR5A1): c.271G>A (p.Gly91Ser) | GGGGTRGCCGGAACAAGTTTGGG, AGGGGTRGCCGGAACAAGTTTGG | 46,XY sex reversal, type 3 |
| 200749741 | NR5A1 | NM_004959.4(NR5A1): c.386C>T (p.Pro129Leu) | GGCGGGRGCACCCCCATCGGGGG, CGGCGGGRGCACCCCCATCGGGG, GCGCGGGRGCACCCCCATCGGG | Premature ovarian failure 7, Spermatogenic failure 8 |
| 121918656 | NR5A1 | NM_004959.4(NR5A1): c.3G>A (p.MetIle) | CATRGACTATTCGTACGACGAGG | 46,XY sex reversal, type 3, Premature ovarian failure 7 |
| 387906690 | NR5A1 | NM_004959.4(NR5A1): c.392C>T (p.Pro131Leu) | CCGATGGGGTGCCCCGCYGCC | Spermatogenic failure 8 |
| 587784131 | NSD1 | NM_022455.4(NSD1): c.4966+1G>A | AAAGRTATGGATTTCTTATGTGG | Sotos syndrome 1 |
| 587784149 | NSD1 | NM_022455.4(NSD1): c.5432G>A (p.Arg1811Gln) | GGCCCRAGTCTTCCCTTACATGG | Sotos syndrome 1 |
| 587784071 | NSD1 | NM_022455.4(NSD1): c.1262G>A (p.Trp421Ter) | AGTAAATRGGAAGCCAGTGTTGG | Sotos syndrome 1 |
| 587784174 | NSD1 | NM_022455.4(NSD1): c.6014G>A (p.Arg2005Gln) | TAGGACCRAATCATTGATGCTGG | Sotos syndrome 1 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587784137 | NSD1 | NM_022455.4(NSD1): c.5098C>T (p.Arg1700Ter) | CCCCTAGGCGGGGCTGCYGAAAT, CCCTAGGCGGGGCTGCYGAAATC, CCTAGGCGGGGCTGCYGAAATCA | Sotos syndrome 1 |
| 587784107 | NSD1 | NM_022455.4(NSD1): c.3964C>T (p.Arg1322Ter) | CCTTCTAGCCCGAGGTYGATCTA | Sotos syndrome 1 |
| 587784117 | NSD1 | NM_022455.4(NSD1): c.4417C>T (p.Arg1473Ter) | CCAAGGAAGCGAAAAYGACAGAG | Sotos syndrome 1 |
| 587784151 | NSD1 | NM_022455.4(NSD1): c.5566C>T (p.Gln1856Ter) | CCCAAAAAGAGCTAAGAYAGCTG, CCAAAAAGAGCTAAGAYAGCTGC | Sotos syndrome 1 |
| 587784176 | NSD1 | NM_022455.4(NSD1): c.6049C>T (p.Arg2017Trp) | CCCAAAGGAAACTATGCTYGGTT, CCAAAGGAAACTATGCTYGGTTC | Sotos syndrome 1 |
| 587784209 | NSD1 | NM_022455.4(NSD1): c.6559C>T (p.Arg2187Ter) | CCTTTTGTAAGCAGCATYGAGAA | Sotos syndrome 1 |
| 587784096 | NSD1 | NM_022455.4(NSD1): c.3091C>T (p.Arg1031Ter) | CCTTCATCCAAATTGYGAGATGC | Sotos syndrome 1 |
| 587776908 | NSUN2 | NM_017755.5(NSUN2): c.2035G>A (p.Gly679Arg) | CCTTTCCCCGCCATCYGCATAAG | Mental retardation, autosomal recessive 5 |
| 587777173 | NT5C2 | NM_012229.4(NT5C2): c.85C>T (p.Arg29Ter) | TTCTCRACGATACTTTTTCAGGG, CTTCTCRACGATACTTTTTCAGG | |
| 150766139 | NTHL1 | NM_002528.5(NTHL1): c.268C>T (p.Gln90Ter) | CAGTCCTRGGGCTCCCAGACTGG | FAMILIAL ADENOMATOUS POLYPOSIS 3 |
| 606231467 | NTRK1 | NM_002529.3(NTRK1): c.1550G>A (p.Gly517Glu) | AGCTGGRGGAGGGCGCCTTTGGG, GAGCTGGRGGAGGGCGCCTTTGG | Hereditary insensitivity to pain with anhidrosis |
| 121964868 | NTRK1 | NM_001007792.1(NTRK1): c.1976C>T (p.Pro659Leu) | CCCATTCGCTGGATGCYGCCCGA, CCATTCGCTGGATGCYGCCCGAG | Hereditary insensitivity to pain with anhidrosis |
| 62637037 | NYX | NM_022567.2(NYX): c.1049G>A (p.Trp350Ter) | AGGGACTRGATGGAGGGCTCCGG | Congenital stationary night blindness, type 1A, not provided |
| 121965042 | OAT | NM_000274.3(OAT): c.812G>A (p.Arg271Lys) | GGCCARAACTGGTAGATGGCTGG | Ornithine aminotransferase deficiency |
| 121965049 | OAT | NM_000274.3(OAT): c.955C>T (p.His319Tyr) | CCATTAAGCCAGGGGAGYATGGG | Ornithine aminotransferase deficiency |
| 121918216 | OBSL1 | NM_015311.2(OBSL1): c.1465C>T (p.Arg489Ter) | CCTTCCAGGGGTCACCYGAGAGG | Three M syndrome 2 |
| 74653330 | OCA2 | NM_000275.2(OCA2): c.1441G>A (p.Ala481Thr) | AGGAGCTRCCACTGCCATCGGGG | Tyrosinase-positive oculocutaneous albinism |
| 121918167 | OCA2 | NM_000275.2(OCA2): c.2228C>T (p.Pro743Leu) | CCCTGATTGACAACATCCYGTTC, CCTGATTGACAACATCCYGTTCA | Tyrosinase-positive oculocutaneous albinism |
| 121918168 | OCA2 | NM_000275.2(OCA2): c.1001C>T (p.Ala334Val) | CCCAGGTGACCATCYGACGGCC, CCAGGTGACCATCYGACGGCCA | Tyrosinase-positive oculocutaneous albinism |
| 137853260 | OCRL | NM_000276.3(OCRL): c.1499G>A (p.Arg500Gln) | TGTGACCRAATTCTTTGGAGAGG | Lowe syndrome |
| 312262864 | OFD1 | NM_003611.2(OFD1): c.1100G>A (p.Arg367Gln) | ATCRACTGATTGAAGATGAAAGG | Oral-facial-digital syndrome |
| 312262812 | OFD1 | NM_003611.2(OFD1): c.221C>T (p.Ser74Phe) | CCCTCTTAATAGGCGCCTYTAAC, CCTCTTAATAGGCGCCTYTAACT | Oral-facial-digital syndrome |
| 312262880 | OFD1 | NM_003611.2(OFD1): c.1420C>T (p.Gln474Ter) | CCTTCTTAGGCCTAGCTYAGCCG | Oral-facial-digital syndrome |
| 28939082 | OPA1 | NM_015560.2(OPA1): c.899G>A (p.Gly300Glu) | TGCTGRAAAGACTAGTGTGTTGG | Dominant hereditary optic atrophy |
| 794727405 | OPA1 | NM_015560.2(OPA1): c.2569C>T (p.Arg857Ter) | CCATTGTAACCTTTGTYGAAGAG | Dominant hereditary optic atrophy, not provided |
| 185836803 | OPLAH | NM_017570.4(OPLAH): c.3265G>A (p.Val1089Ile) | CCAAAGGCCCCCAGGATGAYATC | 5-OXoprolinase deficiency |
| 104894913 | OPN1LW | NM_020061.5(OPN1LW): c.1013G>A (p.Gly338Glu) | TTCGRGAAGAAGGTTGACGATGG | Protan defect |
| 104894912 | OPN1LW | NM_020061.5(OPN1LW): c.739C>T (p.Arg247Ter) | CCAAGTGTGGCTGGCCATCYGAG | Cone monochromatism |
| 28939688 | OPTN | NM_001008211.1(OPTN): c.148G>A (p.Glu50Lys) | ACCRAGAACCACCAGCTGAAAGG | Glaucoma 1, open angle, e |
| 587777528 | ORAI1 | NM_032790.3(ORAI1): c.734C>T (p.Pro245Leu) | CCACCATCATGGTGCYCTTCGGC | Myopathy, tubular aggregate, 2 |
| 143141689 | ORC1 | NM_004153.3(ORC1): c.314G>A (p.Arg105Gln) | CCTGTGCACCAGGCTTCYGGCCC | Meier-Gorlin syndrome 1 |
| 72554349 | OTC | NM_000531.5(OTC): c.299G>A (p.Gly100Asp) | GTAGRCTTTGCACTTCTGGGAGG, ATTGTAGRCTTTGCACTTCTGGG, TATTGTAGRCTTTGCACTTCTGG | not provided |
| 72552296 | OTC | NM_000531.5(OTC): c.3G>A (p.Met1Ile) | AGAAGATRCTGTTTAATCTGAGG | not provided |
| 72552302 | OTC | NM_000531.5(OTC): c.77+5G>A | TAARTGATGGTCAGAGACTTGGG, GTAARTGATGGTCAGAGACTTGG | not provided |
| 72558414 | OTC | NM_000531.5(OTC): c.620G>A (p.Ser207Asn) | ATGATGARCGCAGCGAAATTCGG | not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 72558442 | OTC | NM_000531.5(OTC): c.787G>A (p.Asp263Asn) | ACARACACTTGGATAAGCATGGG, TACARACACTTGGATAAGCATGG | not provided |
| 72554310 | OTC | NM_000531.5(OTC): c.131C>T (p.Thr44Ile) | CCGTGACCTTCTCAYTCTAAAAA | not provided |
| 72556254 | OTC | NM_000531.5(OTC): c.395C>T (p.Ser132Phe) | CCACAGTGTATTGTYTAGCATGG | not provided |
| 72556284 | OTC | NM_000531.5(OTC): c.533C>T (p.Thr178Met) | CCTGGCTGATTACCTCAYGCTCC | not provided |
| 72558426 | OTC | NM_000531.5(OTC): c.659C>T (p.Pro220Leu) | CCTTCAGGCAGCTACTCYAAAGG | not provided |
| 200656442 | OTOA | NM_144672.3(OTOA): c.1352G>A (p.Gly451Asp) | GATGGRCGCACTGCTGGCTGGGG, AGATGGRCGCACTGCTGGCTGGG, CAGATGGRCGCACTGCTGGCTGG | Deafness, autosomal recessive 22 |
| 587777133 | OTOA | NM_144672.3(OTOA): c.1879C>T (p.Pro627Ser) | CCTCTTGGCTGCACTCYCGTAAG | Deafness, autosomal recessive 22 |
| 397515589 | OTOF | NM_194248.2(OTOF): c.1841G>A (p.Gly614Glu) | TCTCTTTGRAGCCTTCCTGGAGG | Deafness, autosomal recessive 9 |
| 80356592 | OTOF | NM_194248.2(OTOF): c.2381G>A (p.Arg794His) | AGCRCCTCAAGTCCTGCATGAGG | Deafness, autosomal recessive 9, not specified |
| 80356594 | OTOF | NM_194248.2(OTOF): c.2991+1G>A | GAGRTGAGGGCCTGGGAGGAGGG, AGAGRTGAGGGCCTGGGAGGAGG, CACAGAGRTGAGGGCCTGGGAGG | Deafness, autosomal recessive 9 |
| 368790049 | OTOF | NM_194248.2(OTOF): c.5815C>T (p.Arg1939Trp) | CGGGCCRGCTGGAGTATGAAGGG | Deafness, autosomal recessive 9 |
| 199848801 | OTOF | NM_194248.2(OTOF): c.3400C>T (p.Arg1134Ter) | TCGGGCCRGCTGGAGTATGAAGG, ACTCRGTACTTGCTGAGCACGGG, CACTCRGTACTTGCTGAGCACGG | Deafness, autosomal recessive 9 |
| 727504936 | OTOF | NM_194248.2(OTOF): c.2818C>T (p.Gln940Ter) | CCAGGAGGTCAAGGCAGCCYAGG | Deafness, autosomal recessive 9 |
| 397514607 | OTOG | NM_001277269.1(OTOG): c.6347C>T (p.Pro2116Leu) | CCGGTGCTCAATCTTCCYTGACC | Deafness, autosomal recessive 18b |
| 786205224 | OTX2 | NM_172337.2(OTX2): c.235G>A (p.Glu79Lys) | CCCRAGTCGAGGGTGCAGGTAGG, CTTGCCCRAGTCGAGGGTGCAGG | Microphthalmia syndromic 5 |
| 121909301 | OXCT1 | NM_000436.3(OXCT1): c.971G>A (p.Gly324Glu) | GGGCATAGRAATCCCTCTCCTGG | Succinyl-CoA acetoacetate transferase deficiency |
| 121909302 | OXCT1 | NM_000436.3(OXCT1): c.656G>A (p.Gly219Glu) | GAGCAGRAAACGTGATTTTCAGG | Succinyl-CoA acetoacetate transferase deficiency |
| 75134564 | OXCT1 | NM_000436.3(OXCT1): c.173C>T (p.Thr58Met) | CCAAAACCRTGGCACCATCAGGG | Succinyl-CoA acetoacetate transferase deficiency |
| 137853890 | P3H1 | NM_001146289.1(P3H1): c.2073G>A (p.Ala691=) | CTCGAGCRGGTGAGAGCAGCTGG | Osteogenesis imperfecta type 8 |
| 118203996 | P3H1 | NM_001146289.1(P3H1): c.1102C>T (p.Arg368Ter) | CCAAGGAGTACCGACAGYGAAGC | Osteogenesis imperfecta type 8 |
| 587784266 | PAFAH1B1 | NM_000430.3(PAFAH1B1): c.405G>A (p.Trp135Ter) | CAGGTGTGRGATTATGAGACTGG | Lissencephaly 1 |
| 587784258 | PAFAH1B1 | NM_000430.3(PAFAH1B1): c.265C>T (p.Arg89Ter) | CCTCTTGGTCAGAAAYGAGACCC | Lissencephaly 1 |
| 74503222 | PAH | NM_000277.1(PAH): c.745C>T (p.Leu249Phe) | AAARCAGGCCAGCCACAGGTCGG, GAGGAAARCAGGCCAGCCACAGG | Phenylketonuria, not provided |
| 62644499 | PAH | NM_000277.1(PAH): c.1243G>A (p.Asp415Asn) | GCTACRACCCATACACCCAAAGG | Hyperphenylalaninemia, non-pku, not provided |
| 62644503 | PAH | NM_000277.1(PAH): c.755G>A (p.Arg252Gln) | TCCTCTCRGGATTTCTTGGGTGG | Phenylketonuria, not provided |
| 62514893 | PAH | NM_000277.1(PAH): c.3G>A (p.Met1Ile) | CAGCATRTCCACTGCGGTCCTGG | Phenylketonuria, not provided |
| 62514959 | PAH | NM_000277.1(PAH): c.977G>A (p.Trp326Ter) | ACTRGTTTACTGTGGAGTTTGGG, TACTRGTTTACTGTGGAGTTTGG | Phenylketonuria, not provided |
| 62516147 | PAH | NM_000277.1(PAH): c.1065+1G>A | ATTACAGRTATGACCTTCACAGG | not provided |
| 62642937 | PAH | NM_000277.1(PAH): c.1139C>T (p.Thr380Met) | CCAAAATTACACTGTCAYGGAGT | Phenylketonuria, Hyperphenylalaninemia, non-pku, not provided |
| 76687508 | PAH | NM_000277.1(PAH): c.721C>T (p.Arg241Cys) | CCCAGCTTGCACTGGTTTCYGCC, CCAGCTTGCACTGGTTTCYGCCT | Phenylketonuria, not provided |
| 5030851 | PAH | NM_000277.1(PAH): c.842C>T (p.Pro281Leu) | CCCATGTATACCCCCGAACYGTG, CCATGTATACCCCCGAACYGTGA | Phenylketonuria, not provided |
| 121434611 | PAK3 | NM_002578.3(PAK3): c.1255C>T (p.Arg419Ter) | CCTGAGCAAAGTAAAYGAAGCAC | Mental retardation 30, X-linked |
| 587776405 | PALB2 | NM_024675.3(PALB2): c.48G>A (p.Lys16=) | GGGAAARGTGCCGGGGGTGCGGG, AGGAAAARGTGCCGGGGGTGCGG | not provided |
| 180177122 | PALB2 | NM_024675.3(PALB2): c.2718G>A (p.Trp906Ter) | AGTGRGAAAAACTTTATACCTGG | Familial cancer of breast |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 180177132 | PALB2 | NM_024675.3(PALB2): c.3113G>A (p.Trp1038Ter) | ATTTRGTAAGCTTTCCCTCTAGG | Familial cancer of breast, Hereditary cancer-predisposing syndrome, Breast cancer, susceptibility to |
| 587782050 | PALB2 | NM_024675.3(PALB2): c.3476G>A (p.Trp1159Ter) | AACATTRGTCTTTTGTGAAATGG | Hereditary cancer-predisposing syndrome |
| 118203999 | PALB2 | NM_024675.3(PALB2): c.2962C>T (p.Gln988Ter) | CCCTTTCTGATCAAYAAGTAGAA | Fanconi anemia, complementation group N, Hereditary cancer-predisposing syndrome, Breast cancer, susceptibility to |
| 587776415 | PALB2 | NM_024675.3(PALB2): c.2074C>T (p.Gln692Ter) | CCAAACTCGCAAAGCYAGCATAC | not provided |
| 180177097 | PALB2 | NM_024675.3(PALB2): c.1027C>T (p.Gln343Ter) | CCAGCAAATGAAAACYAAAACTT | Familial cancer of breast, Pancreatic cancer 3, Breast cancer, susceptibility to |
| 180177111 | PALB2 | NM_024675.3(PALB2): c.2323C>T (p.Gln775Ter) | CCAGTGATACTAAAYAATTCGAC | Familial cancer of breast, Hereditary cancer-predisposing syndrome, Breast cancer, susceptibility to |
| 137852966 | PANK2 | NM_153638.2(PANK2): c.832C>T (p.Arg278Cys) | CCTGACTCTGTGTGGAYGCAAAG | |
| 137853056 | PARK2 | NM_004562.2(PARK2): c.1358G>A (p.Trp453Ter) | AGTRGAACCGCGTCTGCATGGGG, GAGTRGAACCGCGTCTGCATGGG, CGAGTRGAACCGCGTCTGCATGG | Parkinson disease 2 |
| 79555199 | PAX2 | NM_003990.3(PAX2): c.226G>A (p.Gly76Ser) | GAGACCRGCAGCATCAAGCCGGG, CGAGACCRGCAGCATCAAGCCGG | Renal coloboma syndrome |
| 104893651 | PAX3 | NM_181457.3(PAX3): c.251C>T (p.Ser84Phe) | CCCACGGCTGCGTCTYCAAGATC, CCACGGCTGCGTCTYCAAGATCC | Waardenburg syndrome type 1, Klein-Waardenberg syndrome |
| 121917718 | PAX4 | NM_006193.2(PAX4): c.490C>T (p.Arg164Trp) | CCACCCAGGGACCGGCCACYGGA, CCAGGGACCGGCCACYGGAATC | Maturity-onset diabetes of the young, type 9 |
| 121907929 | PAX6 | NM_000280.4(PAX6): c.771G>A (p.Trp257Ter) | CCAGGGACCGGCCACYGGAATCG, GGTATGRTTTTCTAATCGAAGGG, AGGTATGRTTTTCTAATCGAAGG | Aniridia, cerebellar ataxia, and mental retardation |
| 121907912 | PAX6 | NM_000280.4(PAX6): c.406C>T (p.Gln136Ter) | CCTGGCTAGCGAAAAGCAAYAGA | Congenital aniridia |
| 121907917 | PAX6 | NM_000280.4(PAX6): c.718C>T (p.Arg240Ter) | CCAGATGTGTTTGCCYGAGAAAG | Congenital aniridia |
| 28933972 | PAX9 | NM_006194.3(PAX9): c.76C>T (p.Arg26Trp) | CCGCTGCCCAACGCCATCYGGCT | Tooth agenesis, selective, 3 |
| 113994143 | PC | NM_000920.3(PC): c.1351C>T (p.Arg451Cys) | CCCTTGCGGAGTTCYGCGTCCGA | Pyruvate carboxylase deficiency |
| 115117837 | PCBD1 | NM_000281.3(PCBD1): c.263G>A (p.Arg88Gln) | CCAGGTTTATGTCCYGTTCTGAA | Hyperphenylalaninemia, BH4-deficient, D |
| 121913014 | PCBD1 | NM_000281.3(PCBD1): c.236C>T (p.Thr79Ile) | CCACATCACGCTGAGCAYCCATG | Hyperphenylalaninemia, BH4-deficient, D |
| 121913015 | PCBD1 | NM_000281.3(PCBD1): c.292C>T (p.Gln98Ter) | CCTGGCCAGCTTCATCGAAYAAG, CCAGCTTCATCGAAYAAGTAGCA | Hyperphenylalaninemia, BH4-deficient, D |
| 121964960 | PCCB | NM_000532.4(PCCB): c.502G>A (p.Glu168Lys) | CCAARAAGGAGTGGAGTCTTTGG | Propionic acidemia |
| 398123460 | PCCB | NM_000532.4(PCCB): c.183+1G>A | ACAAGCGARTGAGTCCTGAGGGG | Propionic acidemia, not provided |
| 398123464 | PCCB | NM_000532.4(PCCB): c.3G>A (p.Met1Ile) | AATRGCGGCGGCATTACGGGTGG, AAAAATRGCGGCGGCATTACGGG, CAAAAATRGCGGCGGCATTACGG | Propionic acidemia, not provided |
| 374722096 | PCCB | NM_000532.4(PCCB): c.683C>T (p.Pro228Leu) | CCTGTTCATCACTGGCCYTGATG | Propionic acidemia |
| 202247820 | PCCB | NM_000532.4(PCCB): c.1495C>T (p.Arg499Ter) | CCCTTTCCCTGCAGCAGTGYGAG, CCTTTCCCTGCAGCAGTGYGAGG | Propionic acidemia |
| 186710233 | PCCB | NM_000532.4(PCCB): c.1534C>T (p.Arg512Cys) | CCAACCTTCTTCCACAYGTGCCC | Propionic acidemia |
| 132630324 | PCDH19 | NM_001184880.1(PCDH19): c.253C>T (p.Gln85Ter) | CCTGCTGGTCACCAAGYAGAAGA | Early infantile epileptic encephalopathy 9 |
| 796052811 | PCDH19 | NM_001105243.1(PCDH19): c.1031C>T (p.Pro344Leu) | CCAATGACAATCCGCYGGTCATC | not provided |
| 119479062 | PCNT | NM_006031.5(PCNT): c.5767C>T (p.Arg1923Ter) | CCCGAGCTGCAGTGGCTCYGAGC, CCGAGCTGCAGTGGCTCYGAGCG | Microcephalic osteodysplastic primordial dwarfism type 2 |
| 587784321 | PCNT | NM_006031.5(PCNT): c.8917C>T (p.Arg2973Ter) | CCACCTGGGAACAGCAGYGAGAG, CCTCCGGGAACAGCAGYGAGAGC | Microcephalic osteodysplastic primordial dwarfism type 2 |
| 794728683 | PCSK9 | NM_174936.3(PCSK9): c.644G>A (p.Arg215His) | CGGGACCCRCTTCCACAGACAGG | not provided |
| 374603772 | PCSK9 | NM_174936.3(PCSK9): c.1486C>T (p.Arg496Trp) | CCAGGAGTGGGAAGCGGYGGGGC | not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777189 | PCYT1A | NM_005017.3(PCYT1A): c.296C>T (p.Ala99Val) | CTTCRCTTGCATCAGAGCTCGGG, TCTTCRCTTGCATCAGAGCTCGG | Spondylometaphyseal dysplasia with cone-rod dystrophy |
| 794726867 | PDE3A | NM_000921.4(PDE3A): c.1340C>T (p.Ala447Val) | CCACCACCACCTCGGYCACAGGT | Brachydactyly with hypertension |
| 397515433 | PDE4D | NM_001165899.1(PDE4D): c.728C>T (p.Ala243Val) | CCGTCAGTGAGATGGYCTCCAAC | Acrodysostosis 2, with or without hormone resistance |
| 794727139 | PDE6A | NM_000440.2(PDE6A): c.1926+1G>A | CGAGRTAGGATGAGGGCCAAGGG, ACGAGRTAGGATGAGGGCCAAGG | Retinitis pigmentosa 43 |
| 121918578 | PDE6A | NM_000440.2(PDE6A): c.1683G>A (p.Trp561Ter) | CTGRCGGCACGGCTTCAACGTGG | Retinitis pigmentosa 43 |
| 121918581 | PDE6B | NM_000283.3(PDE6B): c.1669C>T (p.His557Tyr) | CCGGAGAATCACCTACYACAACT | Retinitis pigmentosa, Retinitis pigmentosa 40 |
| 397515633 | PDGFB | NM_002608.2(PDGFB): c.445C>T (p.Arg149Ter) | CCCCACCCAGGTGCAGCTGYGAC, CCACCCAGGTGCAGCTGYGACC, CCACCCAGGTGCAGCTGYGACCT, CCCAGGTGCAGCTGYGACCTGTC | Idiopathic basal ganglia calcification 5 |
| 121908587 | PDGFRA | NM_006206.4(PDGFRA): c.2021C>T (p.Thr674Ile) | CCCCATTTACATCATCAYAGAGT, CCCATTTACATCATCAYAGAGTA, CCATTTACATCATCAYAGAGTAT | |
| 397509382 | PDGFRB | NM_002609.3(PDGFRB): c.2959C>T (p.Arg987Trp) | CCACCCAGCCATCCTTYGGTCCC | Basal ganglia calcification, idiopathic, 4 |
| 137853250 | PDHA1 | NM_000284.3(PDHA1): c.1133G>A (p.Arg378His) | AAGTTCRTGGTGCCAATCAGTGG | Pyruvate dehydrogenase E1-alpha deficiency |
| 137853252 | PDHA1 | NM_000284.3(PDHA1): c.904C>T (p.Arg302Cys) | CCCTCCCCATAGTTACYGTACAC, CCTCCCCATAGTTACYGTACACG | Pyruvate dehydrogenase E1-alpha deficiency, not provided |
| 121917722 | PEPD | NM_000285.3(PEPD): c.551G>A (p.Arg184Gln) | CTGAAGCCRAGTGTTTAAGACGG | Prolidase deficiency |
| 121917724 | PEPD | NM_000285.3(PEPD): c.1342G>A (p.Gly448Arg) | TTGGCRGGGTGAGTGCCCACGGG, TTTGGCRGGGTGAGTGCCCACGG | Prolidase deficiency |
| 61750420 | PEX1 | NM_000466.2(PEX1): c.2528G>A (p.Gly843Asp) | TTGRTGGGTTACATGAAGTTAGG | Leber amaurosis, Zellweger syndrome, Peroxisome biogenesis disorders, Zellweger syndrome spectrum, not provided |
| 267608183 | PEX10 | NM_002617.3(PEX10): c.600+1G>A | TACRTAAGTAGCAGGCGCTGAGG | Peroxisome biogenesis disorder 6A |
| 397515419 | PEX11B | NM_003846.2(PEX11B): c.64C>T (p.Gln22Ter) | CCTCTCCTCTAGGGCCGCCYAGT, CCTCTAGGGCCGCCYAGTATGCT | Peroxisome biogenesis disorder 14B |
| 61752112 | PEX12 | NM_000286.2(PEX12): c.949C>T (p.Leu317Phe) | CCGGGTGAATGATACTGTTYTTG | |
| 61752127 | PEX2 | NM_001079867.1(PEX2): c.669G>A (p.Trp223Ter) | TCATGRTGTATTCCTCTTACTGG | Peroxisome biogenesis disorder 5B |
| 28940308 | PEX26 | NM_017929.5(PEX26): c.265G>A (p.Gly89Arg) | TGTTGTRGGATCCAGGCCCTGG | Peroxisome biogenesis disorder 7A |
| 62641228 | PEX26 | NM_017929.5(PEX26): c.292C>T (p.Arg98Trp) | CCCTGGCAGAAATGGATYGGTGG, CCTGGCAGAAATGGATYGGTGGC | Peroxisome biogenesis disorder 7B |
| 61752137 | PEX5 | NM_000319.4(PEX5): c.1255C>T (p.Arg419Ter) | CCTGTGAAACCCTAYGAGACTGG | Peroxisome biogenesis disorder 2A |
| 267608241 | PEX6 | NM_000287.3(PEX6): c.2440C>T (p.Arg814Ter) | CCCCAAGCCGGGGGYGAAGTGGA | Peroxisome biogenesis disorder 4A |
| 267608252 | PEX7 | NM_000288.3(PEX7): c.-45C>T | CCTCCGACTCGGAAYGGCTTCCG | Phytanic acid storage disease |
| 587776970 | PGAP2 | NM_001145438.2(PGAP2): c.479C>T (p.Thr160Ile) | CCACTACCTCAGCTGCAYCTCCC | Hyperphosphatasia with mental retardation syndrome 3 |
| 587777251 | PGAP3 | NM_033419.4(PGAP3): c.275G>A (p.Gly92Asp) | CCCTCCAACTCACCTTGYCATGG, CCTCCAACTCACCTTGYCATGGA | Hyperphosphatasia with mental retardation syndrome 4 |
| 431905503 | PGK1 | NM_000291.3(PGK1): c.756+5G>A | GGTAGRAAACAAATGCCAAGTGG | Phosphoglycerate kinase 1 deficiency |
| 132630299 | PHF6 | NM_001015877.1(PHF6): c.134G>A (p.Cys45Tyr) | TAAGTRCATGGTAAGTATACCGG | Boijeson-Forssman-Lehmann syndrome |
| 587777483 | PHGDH | NM_006623.3(PHGDH): c.488G>A (p.Arg163Gln) | CTACCCRGATGCAGTCCTTTGGG, GCTACCCRGATGCAGTCCTTTGG | Neu-Laxova syndrome 1 |
| 587777770 | PHGDH | NM_006623.3(PHGDH): c.418G>A (p.Gly140Arg) | TTCATGRGAACAGAGCTGAATGG | Neu-Laxova syndrome 1, not provided |
| 587777774 | PHGDH | NM_006623.3(PHGDH): c.793G>A (p.Glu265Lys) | GCAGRAGCCGCCACGGGACCGG, GGCAGRAGCCGCCACGGGACCGG | Neu-Laxova syndrome 1 |
| 267606948 | PHGDH | NM_006623.3(PHGDH): c.1129G>A (p.Gly377Ser) | CATTGTCRGCCTCCTGAAAGAGG | Phosphoglycerate dehydrogenase deficiency |
| 137853590 | PHKG2 | NM_000294.2(PHKG2): c.130C>T (p.Arg44Ter) | CCGCCGTTGTGTTCATYGAGCTA | Glycogen storage disease IXc |
| 104894269 | PHOX2A | NM_005169.3(PHOX2A): c.215C>T (p.Ala72Val) | CCCGCGCCCTACTCGGYAGGTGA, CGCGCGCCCTACTCGGYAGGTGAG | Fibrosis of extraocular muscles, congenital, 2 |
| 587777764 | PIEZO1 | NM_001142864.3(PIEZO1): c.6059C>T (p.Ala2020Val) | GAGGRCGCGGTCAACCACCATGG | Xerocytosis |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777450 | PIEZO2 | NM_022068.3(PIEZO2): c.8057G>A (p.Arg2686His) | CCCACTGAAGAATTCAYGGACAA, CCACTGAAGAATTCAYGGACAAA | Gordon syndrome |
| 368953604 | PIGO | NM_032634.3(PIGO): c.3069+5G>A | CCCTGATCTCTCTCCTACAYCCA, CCTGATCTCTCTCCTACAYCCAC | Hyperphosphatasia with mental retardation syndrome 2 |
| 527236031 | PIGT | NM_015937.5(PIGT): c.1342C>T (p.Arg448Trp) | CCATCCAGTTTGAGYGGGCGCTG | Multiple congenital anomalies-hypotonia-seizures syndrome 3 |
| 397514565 | PIK3CA | NM_006218.2(PIK3CA): c.1133G>A (p.Cys378Tyr) | CCTTRTTCCAATCCCAGGTAAGG | Megalencephaly cutis marmorata telangiectatica congenita, PIK3CA Related Overgrowth Spectrum |
| 121913273 | PIK3CA | NM_006218.2(PIK3CA): c.1624G>A (p.Glu542Lys) | TCTCTCTRAAATCACTGAGCAGG | Congenital lipomatous overgrowth, vascular malformations, and epidermal nevi, Non-small cell lung cancer, Neoplasm of ovary |
| 587777389 | PIK3CD | NM_005026.3(PIK3CD): c.1573G>A (p.Glu525Lys) | GTATRAGCACGAGAAGGACCTGG | Activated PI3K-delta syndrome |
| 121918337 | PIKFYVE | NM_015040.3(PIKFYVE): c.2962C>T (p.Gln988Ter) | CCCTGTGGATGACCAAYAAGATG, CCTGTGGATGACCAAYAAGATGC | Fleck corneal dystrophy |
| 121909109 | PITX1 | NM_002653.4(PITX1): c.388G>A (p.Glu130Lys) | CCTCACCRAGCCGCGCGTGCGGG, ACCTCACCRAGCCGCGCGTGCGG | Talipes equinovarus |
| 104893861 | PITX2 | NM_153427.2(PITX2): c.206G>A (p.Arg69His) | CACRCGAAGAAATCGCTGTGTGG | Iridogoniodysgenesis, dominant type |
| 121909248 | PITX2 | NM_153427.2(PITX2): c.250C>T (p.Arg84Trp) | CCTTACGGAAGCCCGAGTCYGGG | Iridogoniodysgenesis, dominant type |
| 199476102 | PKD1 | NM_001009944.2(PKD1): c.12420G>A (p.Trp4140Ter) | CCTCTGRATGGGCCTCAGCAAGG | Polycystic kidney disease, adult type |
| 199476095 | PKD1 | NM_001009944.2(PKD1): c.12682C>T (p.Arg4228Ter) | CCTGCTCACCCAGTTTGACYGAC | Polycystic kidney disease, adult type |
| 199476096 | PKD1 | NM_001009944.2(PKD1): c.11512C>T (p.Gln3838Ter) | CCGGCTGCGCTTCCTGYAGCTGC | Polycystic kidney disease, adult type |
| 121918042 | PKD2 | NM_000297.3(PKD2): c.1390C>T (p.Arg464Ter) | CCTTTAAAGCTGATCYGATATGT | Polycystic kidney disease 2 |
| 794727680 | PKHD1 | NM_138694.3(PKHD1): c.7194G>A (p.Trp2398Ter) | ACAGTTTGRGAAAGTGCAGGTGG | Polycystic kidney disease, infantile type |
| 786204241 | PKHD1 | NM_138694.3(PKHD1): c.8303-1G>A | CACARACAGAACTGTCCTTGTG | Polycystic kidney disease, infantile type |
| 398124479 | PKHD1 | NM_138694.3(PKHD1): c.2407+1G>A | TTCTGRTAAAGGGGTGATTGGGG, TTTCTGRTAAAGGGGTGATTGGG, ATTTCTGRTAAAGGGGTGATTGG | Polycystic kidney disease, infantile type, not provided |
| 137852946 | PKHD1 | NM_138694.3(PKHD1): c.5221G>A (p.Val1741Met) | ACAGCARTGACGGAGAACTTCGG | Polycystic kidney disease, infantile type, not provided |
| 28937907 | PKHD1 | NM_138694.3(PKHD1): c.4991G>T (p.Ser1664Phe) | CCAGAATTGATCTCTATTTYTCA | Polycystic kidney disease, infantile type |
| 773136605 | PKHD1 | NM_138694.3(PKHD1): c.2854G>A (p.Gly952Arg) | CCAGAGAAACCAGTTCYGGTAAT | Polycystic kidney disease, infantile type |
| 727504096 | PKHD1 | NM_138694.3(PKHD1): c.370C>T (p.Arg124Ter) | CCAAATCCAGGACCAYGAGATAG | Polycystic kidney disease, infantile type, not provided |
| 398124478 | PKHD1 | NM_138694.3(PKHD1): c.2341C>T (p.Arg781Ter) | CCTGGTGACGACACAGAYGAC | Polycystic kidney disease, infantile type, not provided |
| 398124480 | PKHD1 | NM_138694.3(PKHD1): c.2452C>T (p.Gln818Ter) | CCTTCACCAGCTCTTAYAGAATA | Polycystic kidney disease, infantile type, not provided |
| 137852944 | PKHD1 | NM_138694.3(PKHD1): c.107C>T (p.Thr36Met) | CCTTGCAGGGGGAAYGTGGATCA | Polycystic kidney disease, infantile type, not provided |
| 137852945 | PKHD1 | NM_138694.3(PKHD1): c.9053C>T (p.Ser3018Phe) | CCTGGATCATATCATYTACTCTG | Polycystic kidney disease, infantile type |
| 137852947 | PKHD1 | NM_138694.3(PKHD1): c.8011C>T (p.Arg2671Ter) | CCTCCTAAGATGTGGGAGTYGAG, CCTAAGATGTGGGAGTYGAGTGG | Polycystic kidney disease, infantile type |
| 118204085 | PKLR | NM_000298.5(PKLR): c.1436G>A (p.Arg479His) | TGGCCRGTGAGGGGATATTGGG, CTGGCCRGTGAGGGGATATTGG | |
| 116100695 | PKLR | NM_000298.5(PKLR): c.1456C>T (p.Arg486Trp) | TCGGTACCRAGACAGAAGCTGGG | Pyruvate kinase deficiency of red cells |
| 118204083 | PKLR | NM_000298.5(PKLR): c.487C>T (p.Arg163Cys) | CCAAGGGACCGGAGATCYGCACT | Pyruvate kinase deficiency of red cells |
| 74315362 | PKLR | NM_000298.5(PKLR): c.1151C>T (p.Thr384Met) | CCAAGCCCCGGCCAAYGAGGGCA | Pyruvate kinase deficiency of red cells |
| 121918354 | PKP1 | NM_000299.3(PKP1): c.910C>T (p.Gln304Ter) | CCCAACCAGAACGTCYAGCAGG, CCCAACCAGAACGTCYAGCAGGC, CCAACCAGAACGTCYAGCAGGCC | Ectodermal dysplasia skin fragility syndrome |
| 766209297 | PKP2 | NM_004572.3(PKP2): c.1162C>T (p.Arg388Trp) | TCTTCCRAGCTTCAGATTTCTGG | not provided |
| 794729103 | PKP2 | NM_004572.3(PKP2): c.517C>T (p.Gln173Ter) | CCAGTACAGCCAGAGAAGCYAGG | not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908686 | PLA2G6 | NM_003560.2(PLA2G6): c.2222G>A (p.Arg741Gln) | GGCRGGCTGTGGACCGGGCACGG, AGACGGGCRGGCTGTGGACCGGG | Parkinson disease 14 |
| 370691849 | PLA2G6 | NM_003560.2(PLA2G6): c.1612C>T (p.Arg538Cys) | CATGCCGCRCATGTAGGCCATGG | Iron accumulation in brain |
| 121908683 | PLA2G6 | NM_003560.2(PLA2G6): c.1894C>T (p.Arg632Trp) | CCTAGACCAGCTGGTGTGGYGGG | Karak syndrome |
| 587784338 | PLA2G6 | NM_003560.2(PLA2G6): c.1754C>T (p.Thr585Ile) | CCAGGGTGATGCTGAYAGGGACA | Iron accumulation in brain |
| 587784357 | PLA2G6 | NM_003560.2(PLA2G6): c.517C>T (p.Gln173Ter) | CCTGGTGGAGCTGGTGYAGTACT | Iron accumulation in brain |
| 397514770 | PLCB4 | NM_001172646.1(PLCB4): c.1078G>A (p.Asp360Asn) | CTTRACTGCTGGGATGGAAAAGG | Auriculocondylar syndrome 2 |
| 397514470 | PLCD1 | NM_006225.3(PLCD1): c.1246C>T (p.Arg416Ter) | CCCCATGCTGTTGAACYGACCAC, CCATGCTGTTGAACYGACCACT, CCATGCTGTTGAACYGACCACTG | Leukonychia totalis |
| 121912605 | PLCE1 | NM_016341.3(PLCE1): c.4451C>T (p.Ser1484Leu) | CCTGCCAATCATCATATYGATTG | Nephrotic syndrome, type 3 |
| 137853160 | PLEC | NM_000445.4(PLEC): c.913C>T (p.Gln305Ter) | CCTGCCCGCAGGAGCTGYAGCTG | Epidermolysis bullosa simplex with pyloric atresia |
| 387906801 | PLEC | NM_000445.4(PLEC): c.6169C>T (p.Gln2057Ter) | CCTGCGGGAGCGAGCGGAGYAGG | Epidermolysa bullosa simplex and limb girdle muscular dystrophy |
| 387906802 | PLEC | NM_000445.4(PLEC): c.6955C>T (p.Arg2319Ter) | CCCAAGAGGCTGCGYGACTGCGG | Epidermolysa bullosa simplex and limb girdle muscular dystrophy |
| 786205055 | PLEKHM1 | NM_014798.2(PLEKHM1): c.296+1G>A | CAARTGAGATTTAGCTGGAGAGG, ACCCACAARTGAGATTTAGCTGG | Osteopetrosis autosomal recessive 6 |
| 121918027 | PLG | NM_000301.3(PLG): c.1858G>A (p.Ala620Thr) | GTTGACTRCTGCCCACTGCTTGG | Dysplasminogenemia |
| 121918030 | PLG | NM_000301.3(PLG): c.704G>A (p.Arg235His) | TTACTGTCRTAACCCCGATAGGG | Plasminogen deficiency, type I |
| 121913550 | PLOD1 | NM_000302.3(PLOD1): c.955C>T (p.Arg319Ter) | CCCCCAGAAACACATGYGACTTT, CCCCAGAAACACATGYGACTTTT, CCCAGAAACACATGYGACTTTTC | Ehlers-Danlos syndrome, hydroxylysine-deficient |
| 132630278 | PLP1 | NM_001128834.2(PLP1): c.646C>T (p.Pro216Ser) | CCCATGGAATGCTTTCYCTGGCA, CCATGGAATGCTTTCYCTGGCAA | Pelizaeus-Merzbacher disease, not provided |
| 132630293 | PLP1 | NM_001128834.2(PLP1): c.725C>T (p.Ala242Val) | CCTTCCACCTGTTTATTGYTGCA, CCACCTGTTTATTGYTGCATTTG | not provided |
| 132630294 | PLP1 | NM_001128834.2(PLP1): c.509C>T (p.Ser170Phe) | CCTGGTGTTTGCCTGCTYTGCTG | Spastic paraplegia 2 |
| 80338707 | PMM2 | NM_000303.2(PMM2): c.691G>A (p.Val231Met) | CTACTCCRTGACAGCGCCTGAGG | Carbohydrate-deficient glycoprotein syndrome type I, not provided |
| 104894621 | PMP22 | NM_000304.3(PMP22): c.215C>T (p.Ser72Leu) | CCACCATGATCCTGTYGATCATC | Dejerine-Sottas disease, Dejerine-Sottas syndrome, autosomal dominant |
| 587778617 | PMS2 | NM_000535.5(PMS2): c.1261C>T (p.Arg421Ter) | CCATTTCCAGACTGYGAGAGGCC | Hereditary Nonpolyposis Colorectal Neoplasms, not specified |
| 267606956 | PNKP | NM_007254.3(PNKP): c.976G>A (p.Glu326Lys) | CTGAGRAGTTCTTTCTCAAGTGG | Early infantile epileptic encephalopathy 10, not provided |
| 104894453 | PNP | NM_000270.3(PNP): c.265G>A (p.Glu89Lys) | TGTATRAAGGGTACCCACTCTGG | Purine-nucleoside phosphorylase deficiency |
| 121918260 | PNPLA2 | NM_020376.3(PNPLA2): c.865C>T (p.Gln289Ter) | CCAAGCGGAGGATTACTCGYAGC | Neutral lipid storage disease with myopathy |
| 142422525 | PNPLA6 | NM_006702.4(PNPLA6): c.3382G>A (p.Gly1128Ser) | TGTCCRGCTGGTGGCTGCTGTGG | Trichomegaly with mental retardation, dwarfism and pigmentary degeneration of retina |
| 587777185 | PNPLA6 | NM_006702.4(PNPLA6): c.2375G>A (p.Gly792Glu) | GTCAGRGTGGCTGGCCCAGCAGG | Spastic paraplegia 39 |
| 786201037 | PNPLA6 | NM_006702.4(PNPLA6): c.3152G>A (p.Arg1051Gln) | TGCRAGTCCACAAAGATGGTGGG, ATGCRAGTCCACAAAGATGGTGG, GCCATGCRAGTCCACAAAGATGG | Trichomegaly with mental retardation, dwarfism and pigmentary degeneration of retina |
| 587777181 | PNPLA6 | NM_006702.4(PNPLA6): c.3029C>T (p.Thr1010Ile) | CCTCACGTACCCAGTCAYCTCCA | Boucher Neuhauser syndrome |
| 587777854 | PNPLA6 | NM_006702.4(PNPLA6): c.3295C>T (p.Arg1099Cys) | CCCCACAGCGGACATCGCCYGCA, CCCACAGCGGACATCGCCYGCAG, CCACAGCGGACATCGCCYGCAGC | Boucher Neuhauser syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 773450573 | PNPO | NM_018129.3(PNPO): c.686G>A (p.Arg229Gln) | GACCRGATAGTCTTTCGGCGGGG, TGACCRGATAGTCTTTCGGCGGG, ATGACCRGATAGTCTTTCGGCGG | not provided |
| 104894629 | PNPO | NM_018129.3(PNPO): c.685C>T (p.Arg229Trp) | CCAACCGCCTGCATGACYGGATA | "Pyridoxal 5-phosphate-dependent epilepsy" |
| 397514487 | POC1A | NM_015426.4(POC1A): c.241C>T (p.Arg81Ter) | CCTGCTTGCTTCCGGCTCCYGAG | Short stature, onychodysplasia, facial dysmorphism, and hypotrichosis, Primordial dwarfism |
| 587777293 | POGLUT1 | NM_152305.2(POGLUT1): c.11G>A (p.Trp4Ter) | GGTRGGCTAGCTCGCCGCTTCGG | Dowling-degos disease 4 |
| 199759055 | POLG | NM_002693.2(POLG): c.1156C>T (p.Arg386Cys) | GTTCTCACRAATGTCCTTCATGG | not provided |
| 769410130 | POLG | NM_002693.2(POLG): c.915C>G (p.Ser305Arg) | GAAGCTRCTTAGCCCTGAGATGG | not provided |
| 796052888 | POLG | NM_002693.2(POLG): c.2558G>A (p.Arg853Gln) | GCCRGGCTGTGGAGCCCACATGG | not provided |
| 121918055 | POLG | NM_002693.2(POLG): c.1532G>A (p.Ser511Asn) | CCARCAAGTTGCCCATCGAGGGG, GCCARCAAGTTGCCCATCGAGGG, AGCCARCAAGTTGCCCATCGAGG | Autosomal dominant progressive external ophthalmoplegia with mitochondrial DNA deletions 1 |
| 144500145 | POLG | NM_002693.2(POLG): c.2554C>T (p.Arg852Cys) | AGCCCGGCRAGTGATGGTGCCGG | Sensory ataxic neuropathy, dysarthria, and ophthalmoparesis, Cerebellar ataxia infantile with progressive external ophthalmoplegia, not provided |
| 113994098 | POLG | NM_002693.2(POLG): c.2542G>A (p.Gly848Ser) | TGCCRGCACCATCACTCGCCGGG, CTGCCRGCACCATCACTCGCCGG | Progressive sclerosing poliodystrophy, Cerebellar ataxia infantile with progressive external ophthalmoplegia, Mitochondrial DNA depletion syndrome 4B, MNGIE type, not provided |
| 56047213 | POLG | NM_002693.2(POLG): c.3406G>A (p.Glu1136Lys) | CCAGGTAGCGAACCTYGTCATGG | not provided |
| 121918053 | POLG | NM_002693.2(POLG): c.2557C>T (p.Arg853Trp) | CCGGCACCATCACTCGCYGGGCT | Cerebellar ataxia infantile with progressive external ophthalmoplegia, not provided |
| 121918056 | POLG | NM_002693.2(POLG): c.679C>T (p.Arg227Trp) | CCTGGTGCAGCCAGYGGCTGGTG | Mitochondrial DNA depletion syndrome 4B, MNGIE type |
| 113994094 | POLG | NM_002693.2(POLG): c.752C>T (p.Thr251Ile) | CCCCCTGGAGGTCCCTAYTGGTG, CCCCTGGAGGTCCCTAYTGGTGC, CCCTGGAGGTCCCTAYTGGTGCC, CCTGGAGGTCCCTAYTGGTGCCA | Myoneural gastrointestinal encephalopathy syndrome, Progressive sclerosing poliodystrophy, Cerebellar ataxia infantile with progressive external ophthalmoplegia, Mitochondrial DNA depletion syndrome 4B, MNGIE type, not specified, not provided |
| 113994096 | POLG | NM_002693.2(POLG): c.1760C>T (p.Pro587Leu) | CCCTGCATGGACCCYGGGCCCCA | Myoneural gastrointestinal encephalopathy syndrome, Cerebellar ataxia infantile with progressive external ophthalmoplegia, Mitochondrial DNA depletion syndrome 4B, MNGIE type, not specified, not provided |
| 141156009 | POLR1C | NM_203290.2(POLR1C): c.835C>T (p.Arg279Trp) | CCAGAGTTGCCAACCCCYGGCTG | Mandibulofacial dysostosis, Treacher Collins type, autosomal recessive |
| 796052126 | POLR1C | NM_203290.2(POLR1C): c.77C>T (p.Thr26Ile) | CCTTTGCTCTAGGTCCATAYTAC | LEUKODYSTROPHY, HYPOMYELINATING, 11 |
| 267608673 | POLR3A | NM_007055.3(POLR3A): c.1114G>A (p.Asp372Asn) | TCTCGCCCRACCCCAACCTCCGG | Hypomyelinating leukodystrophy 7 |
| 267608677 | POLR3A | NM_007055.3(POLR3A): c.1909+18G>A | GAACTCRGGTGGGAGAAGGAGG | Hypomyelinating leukodystrophy 7 |
| 267608680 | POLR3A | NM_007055.3(POLR3A): c.3991G>A (p.Ala1331Thr) | TCTTTGACRCTGCCTACTTCGGG | Hypomyelinating leukodystrophy 7 |
| 267608678 | POLR3A | NM_007055.3(POLR3A): c.418C>T (p.Arg140Ter) | CCTGACCTACCTTCAGAAGYGAG, CCTACCTTCAGAAGYGAGGACTG | Hypomyelinating leukodystrophy 7 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387907299 | POMGNT2 | NM_032806.5(POMGNT2): c.1333C>T (p.Arg445Ter) | CCCCGAGTGGCTCTTCYGAATCT, CCCGAGTGGCTCTTCYGAATCTA, CCGAGTGGCTCTTCYGAATCTAC | Congenital muscular dystrophy-dystroglycanopathy with brain and eye anomalies, type A8 |
| 28941782 | POMT1 | NM_007171.3(POMT1): c.226G>A (p.Gly76Arg) | CTTGRGAGGTAGGAGTCATCAGG | Walker-Warburg congenital muscular dystrophy |
| 397515400 | POMT1 | NM_007171.3(POMT1): c.1241C>T (p.Thr414Met) | CCACCCGCTCCCTGAACAYGTGA, CCCGCTCCCTGAACAYGTGAGTG, CCGCTCCCTGAACAYGTGAGTGT | Limb-girdle muscular dystrophy-dystroglycanopathy, type C1 |
| 267606969 | POMT2 | NM_013382.5(POMT2): c.2177G>A (p.Gly726Glu) | TTACGRGATGGTTGGTCCCCTGG | Congenital muscular dystrophy-dystroglycanopathy with brain and eye anomalies, type A2, Congenital muscular dystrophy-dystroglycanopathy with mental retardation, type B2 |
| 119463989 | POMT2 | NM_013382.5(POMT2): c.1912C>T (p.Arg638Ter) | CCCAGGTCCTGCTGYGAGGAGGC | Congenital muscular dystrophy-dystroglycanopathy with brain and eye anomalies, type A2 |
| 533916138 | POMT2 | NM_013382.5(POMT2): c.1006+1G>A | CCCAGAGACACTCAYGTTCAGGG | Congenital muscular dystrophy-dystroglycanopathy with brain and eye anomalies, type A2 |
| 786205099 | POR | NM_000941.2(POR): c.731+1G>A | CCAGRTGAGCAAGTGCCCGCAGG | Antley-Bixler syndrome with genital anomalies and disordered steroidogenesis |
| 28931607 | POR | NM_000941.2(POR): c.1706G>A (p.Cys569Tyr) | CGGCTRCCGCCGCTCGGATGAGG | Disordered steroidogenesis due to cytochrome p450 oxidoreductase deficiency |
| 104893755 | POU1F1 | NM_001122757.2(POU1F1): c.889C>T (p.Arg297Trp) | CCGGAGGCAGAGAGAAAAYGGG | Pituitary hormone deficiency, combined 1 |
| 104893757 | POU1F1 | NM_001122757.2(POU1F1): c.71C>T (p.Pro24Leu) | CCTCTGCAACTCTGCYTCTGATA | Pituitary hormone deficiency, combined 1 |
| 111033345 | POU3F4 | NM_000307.4(POU3F4): c.499C>T (p.Arg167Ter) | CCTGCACCCGGTGCTCYGAGAGC | Deafness, X-linked 2 |
| 121909056 | POU4F3 | NM_002700.2(POU4F3): c.865C>T (p.Leu289Phe) | CCGGAGAAGCGTTCAYTCGAGGC | Deafness, autosomal dominant 15 |
| 72551362 | PPARG | NM_138712.3(PPARG): c.868G>A (p.Val290Met) | TCGCTCCRTGGAGGCTGTGCAGG | Lipodystrophy, familial partial, type 3 |
| 121918325 | PPDX | NM_001122764.1(PPDX): c.502C>T (p.Arg168Cys) | CCATGGACAGTCTCTGCYGTGGA | Variegate porphyria |
| 387907110 | PRDM5 | NM_018699.3(PRDM5): c.1768C>T (p.Arg590Ter) | CCTGAAGAAAATGCTGATTYGAC | Brittle cornea syndrome 2 |
| 104894176 | PRF1 | NM_001083116.1(PRF1): c.1122G>A (p.Trp374Ter) | CTCGCTGRAGGGACTGCAGCCGG | Hemophagocytic lymphohistiocytosis, familial, 2, Malignant lymphoma, non-Hodgkin |
| 104894180 | PRF1 | NM_001083116.1(PRF1): c.190C>T (p.Gln64Ter) | CCTTCCCAGTGGACACAYAAAGG | Hemophagocytic lymphohistiocytosis, familial, 2 |
| 35418374 | PRF1 | NM_001083116.1(PRF1): c.11G>A (p.Arg4His) | CCCAGGAGGAGCAGAYGGGCTGC, CCAGGAGGAGCAGAYGGGCTGCC | Aplastic anemia |
| 113994140 | PRICKLE1 | NM_153026.2(PRICKLE1): c.311G>A (p.Arg104Gln) | CAGCRGAAGAAAGAAGCACTGGG, TCAGCRGAAGAAAGAAGCACTGG | Progressive myoclonus epilepsy with ataxia |
| 587776773 | PRKAR1A | NM_002734.4(PRKAR1A): c.-7+1G>A | CAGRTGAGTGGGGTCGGCCGGGG, CCAGRTGAGTGGGGTCGGCCGGG, CCCAGRTGAGTGGGGTCGGCCGG | Pigmented nodular adrenocortical disease, primary, 1 |
| 281864780 | PRKAR1A | NM_212472.2(PRKAR1A): c.82C>T (p.Gln28Ter) | CCAGAAGCATAACATTYAAGCGC | Carney complex, type 1 |
| 398122958 | PRKCD | NM_006254.3(PRKCD): c.1352+1G>A | CACRTACGTAAGGGCCATGGTGG, TGCCACRTACGTAAGGGCCATGG | Common variable immunodeficiency 9 |
| 121918514 | PRKCG | NM_002739.3(PRKCG): c.353G>A (p.Gly118Asp) | ACTGTGRCTCCCTCCTCTACGGG, CACTGTGRCTCCCTCCTCTACGG | Spinocerebellar ataxia 14 |
| 386134164 | PRKCG | NM_002739.3(PRKCG): c.367G>A (p.Gly123Arg) | CTCTACRGGCTTGTGCACCAGGG, CCTCTACRGGCTTGTGCACCAGG | Spinocerebellar ataxia 14 |
| 386134165 | PRKCG | NM_002739.3(PRKCG): c.368G>A (p.Gly123Glu) | CTCTACGRGCTTGTGCACCAGGG, CCTCTACGRGCTTGTGCACCAGG | Spinocerebellar ataxia 14 |
| 386134167 | PRKCG | NM_002739.3(PRKCG): c.392G>A (p.Cys131Tyr) | AATCTCCTGTGAGTGACCTGGG, AAATRCCTGTGAGTGACCTGG | Spinocerebellar ataxia 14 |
| 386134171 | PRKCG | NM_002739.3(PRKCG): c.1078G>A (p.Gly360Ser) | AAARGCAGTTTTGGGAAGGTTGG, AGGAAAARGCAGTTTTGGGAAGG | Spinocerebellar ataxia 14 |
| 121918511 | PRKCG | NM_002739.3(PRKCG): c.301C>T (p.His101Tyr) | CCAGGACCCCGGAACAAAYACA | Spinocerebellar ataxia 14 |
| 142742242 | PROC | NM_000312.3(PROC): c.1201G>A (p.Asp401Asn) | GGGCRACAGTGGGGGGCCCATGG | Thrombophilia, hereditary, due to protein C deficiency, autosomal dominant |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918149 | PROC | NM_000312.3(PROC): c.226G>A (p.Val76Met) | AAAATRTGGATGACACAGTAAGG | Thrombophilia, hereditary, due to protein C deficiency, autosomal recessive |
| 121918144 | PROC | NM_000312.3(PROC): c.902C>T (p.Ala301Val) | CCACCGACAATGACATCGYACTG, CCGACAATGACATCGYACTGCTG | Thrombophilia, hereditary, due to protein C deficiency, autosomal recessive |
| 121918160 | PROC | NM_000312.3(PROC): c.935C>T (p.Ser312Leu) | CCCAGCCCGCCACCCTCTYGCAG, CCAGCCCGCCACCCTCTYGCAGA | Thrombophilia, hereditary, due to protein C deficiency, autosomal dominant |
| 757583846 | PROC | NM_000312.3(PROC): c.169C>T (p.Arg57Trp) | CCGTCACAGCAGCCTGGAGYGGG | Thrombophilia, hereditary, due to protein C deficiency, autosomal dominant |
| 3970559 | PRODH | NM_016335.4(PRODH): c.1357C>T (p.Arg453Cys) | CACRGGCTCGCTCCTGGGCCAGG, TGCCGCACRGGCTCGCTCCTGGG | Proline dehydrogenase deficiency, Schizophrenia 4 |
| 376142095 | PROKR2 | NM_144773.2(PROKR2): c.743G>A (p.Arg248Gln) | CCTTGAACCAGAGCTCCYGGGAG | |
| 137853006 | PROM1 | NM_006017.2(PROM1): c.1117C>T (p.Arg373Cys) | CCTGACAGAGTACAAYGCCAAAC | Bull eye macular dystrophy, Stargardt disease 4, Cone-rod dystrophy 12 |
| 137853100 | PROP1 | NM_006261.4(PROP1): c.296G>A (p.Arg99Gln) | GGCCCRAGAGAGTCTTGCCCGGG, GGGCCCRAGAGAGTCTTGCCCGG | Pituitary hormone deficiency, combined 2 |
| 121917843 | PROP1 | NM_006261.4(PROP1): c.217C>T (p.Arg73Cys) | CCCGGCGCCGCCACYGCACCACC | Pituitary hormone deficiency, combined 2 |
| 121917844 | PROP1 | NM_006261.4(PROP1): c.295C>T (p.Arg99Ter) | CCCCGACATCTGGGCCYGAGAGA, CCCGACATCTGGGCCYGAGAGAG, CCGACATCTGGGCCYGAGAGAGT | Pituitary hormone deficiency, combined 2 |
| 794727001 | PRPF31 | NM_015629.3(PRPF31): c.1073+1G>A | CCGCAGRTGAGGGGCCCTGGGGG, GCCGCAGRTGAGGGGCCCTGGGG, GGCCGCAGRTGAGGGGCCCTGGG | Retinitis pigmentosa 11 |
| 587777599 | PRPF4 | NM_004697.4(PRPF4): c.944C>T (p.Pro315Leu) | CCTTTCCAGTGATGAACYAGTGG | Retinitis pigmentosa 70 |
| 61755789 | PRPH2 | NM_000322.4(PRPH2): c.500G>A (p.Gly167Asp) | CTGCGRCAACAACGGTTTTCGGG, GCTGCGRCAACAACGGTTTTCGG | Patterned dystrophy of retinal pigment epithelium, not provided |
| 121918566 | PRPH2 | NM_000322.4(PRPH2): c.947G>A (p.Trp316Ter) | GGAGACCTRGAAGGCCTTTCTGG | Macular dystrophy, vitelliform, adult-onset, not provided |
| 527236097 | PRPH2 | NM_000322.4(PRPH2): c.410G>A (p.Gly137Asp) | GAACGRCATGAAGTACTACCGGG, AGAACGRCATGAAGTACTACCGG | Retinitis pigmentosa |
| 527236098 | PRPH2 | NM_000322.4(PRPH2): c.499G>A (p.Gly167Ser) | CTGCRGCAACAACGGTTTTCGGG, GCTGCRGCAACAACGGTTTTCGG | Retinitis pigmentosa |
| 61755771 | PRPH2 | NM_000322.4(PRPH2): c.136C>T (p.Arg46Ter) | CCTGAAGATTGAACTCYGAAAGA | Retinitis pigmentosa 7, not provided |
| 61755806 | PRPH2 | NM_000322.4(PRPH2): c.647C>T (p.Pro216Leu) | CCTTTCAGCTGCTGCAATCYTAG | Retinitis pigmentosa 7, not provided |
| 387907125 | PRRT2 | NM_145239.2(PRRT2): c.950G>A (p.Ser317Asn) | TAARCATCGTGGCGCTGGTGGGG, TTAARCATCGTGGCGCTGGTGGG, CTTAARCATCGTGGCGCTGGTGG, GCTCTTAARCATCGTGGCGCTGG | Infantile convulsions and paroxysmal choreoathetosis, familial |
| 397514579 | PRRT2 | NM_145239.2(PRRT2): c.748C>T (p.Gln250Ter) | CCGCCACCCCAGCTCCYAGTTGG | Dystonia 10, Seizures, benign familial infantile, 2 |
| 387907127 | PRRT2 | NM_145239.2(PRRT2): c.487C>T (p.Gln163Ter) | CCAGAGCTCCCTACCYAGGAGGA | Dystonia 10, Infantile convulsions and paroxysmal choreoathetosis, familial, not provided |
| 730882158 | PRSS56 | NM_001195129.1(PRSS56): c.958G>A (p.Gly320Arg) | GCCCRGGGTCTACACCCGCGTGG | Microphthalmia, isolated 6 |
| 3814290 | PRX | NM_181882.2(PRX): c.1951G>A (p.Asp651Asn) | TGTGCCCRATGTGCACCTCCCGG | Charcot-Marie-Tooth disease, type IVF, not provided |
| 104894708 | PRX | NM_181882.2(PRX): c.3208C>T (p.Arg1070Ter) | CCTTCCTTTGGGCTGGCTYGAGG, CCTTTGGGCTGGCTYGAGGGAAG | Dejerine-Sottas disease, Charcot-Marie-Tooth disease, type IVF |
| 121917807 | PSEN1 | NM_000021.3(PSEN1): c.796G>A (p.Gly266Ser) | GAAARGTCCACTTCGTATGCTGG | Alzheimer disease, familial, 3, with spastic paraparesis and apraxia |
| 63750577 | PSEN1 | NM_000021.3(PSEN1): c.509C>T (p.Ser170Phe) | CCTGGCTTATTATATCATYTCTA | Alzheimer disease, type 3, not provided |
| 63750048 | PSEN2 | NM_000447.2(PSEN2): c.254C>T (p.Ala85Val) | CCCTCAAATACGGAGYGAAGCAC, CCTCAAATACGGAGYGAAGCACG | Alzheimer disease, type 4, not provided |
| 138911275 | PTCH1 | NM_000264.3(PTCH1): c.3155C>T (p.Thr1052Met) | CGGCCRTCCAGGGGTTCAGAAGG | Gorlin syndrome, Holoprosencephaly sequence, Holoprosencephaly 7, not specified, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199476091 | PTCH1 | NM_000264.3(PTCH1): c.1177G>A (p.Ala393Thr) | CAAAGCGRCAGCCATCCTGGAGG | Holoprosencephaly 7 |
| 587776628 | PTCH2 | NM_003738.4(PTCH2): c.3357+5C>T | GTGTGRTCACCTCTGGCGGCGGG, GGTGTGRTCACCTCTGGCGGCGG | |
| 587776674 | PTEN | NM_000314.6(PTEN): c.-764G>A | GCGAGRGAGATGAGAGACGGCGG, CAGGCGAGRGAGATGAGAGACGG | Cowden syndrome 1, not specified |
| 121909234 | PTEN | NM_000314.6(PTEN): c.649G>A (p.Val217Ile) | GTTTGTGRTCTGCCAGCTAAAGG | Malignant melanoma |
| 786204859 | PTEN | NM_000314.6(PTEN): c.407G>A (p.Cys136Tyr) | TATRTGCATATTTATTACATCGG | Hereditary cancer-predisposing syndrome |
| 587781255 | PTEN | NM_000314.6(PTEN): c.379G>A (p.Gly127Arg) | AAAGCTRGAAAGGGACGAACTGG | PTEN hamartoma tumor syndrome |
| 202004587 | PTEN | NM_000314.6(PTEN): c.235G>A (p.Ala79Thr) | ACCRCCAAATTTAATTGCAGAGG | PTEN hamartoma tumor syndrome, Hereditary cancer-predisposing syndrome, not specified, not provided |
| 786204856 | PTEN | NM_000314.6(PTEN): c.284C>T (p.Pro95Leu) | CCTTTTGAAGACCATAACCYACC | Hereditary cancer-predisposing syndrome |
| 121909219 | PTEN | NM_000314.6(PTEN): c.697C>T (p.Arg233Ter) | CCAATTCAGGACCCACAYGACGG | Bannayan-Riley-Ruvalcaba syndrome, PTEN hamartoma tumor syndrome, Cowden syndrome 1, Hereditary cancer-predisposing syndrome |
| 121434604 | PTH1R | NM_000316.2(PTH1R): c.310C>T (p.Arg104Ter) | CCCACTGGCAGCAGGTACYGAGG, CCACTGGCAGCAGGTACYGAGGT | Chondrodysplasia Blomstrand type |
| 397507541 | PTPN11 | NM_002834.3(PTPN11): c.1492C>T (p.Arg498Trp) | CCATCCAGATGGTGYGGTCTCAG | Noonan syndrome 1, LEOPARD syndrome 1, Rasopathy |
| 121434507 | PTPRJ | NM_002843.3(PTPRJ): c.640C>T (p.Arg214Cys) | CCCAGTTTCTGATCTCYGTGTTG, CCAGTTTCTGATCTCYGTGTTGC | Carcinoma of colon |
| 104894273 | PTS | NM_000317.2(PTS): c.74G>A (p.Arg25Gln) | AGCCACCRATTGTACAGGTAGGG, GAGCCACCRATTGTACAGGTAGG | 6-pyruvoyl-tetrahydropterin synthase deficiency |
| 104894274 | PTS | NM_000317.2(PTS): c.46C>T (p.Arg16Cys) | CCAGGCACAAGTGTCCYGCCGCA | Hyperphenylalaninemia, bh4-deficient, a, due to partial pts deficiency |
| 398123001 | PUF60 | NM_078480.2(PUF60): c.505C>T (p.His169Tyr) | CCGTCACCATGAAGYACAAGGTC | Verheij syndrome |
| 587782993 | PURA | NM_005859.4(PURA): c.556C>T (p.Gln186Ter) | CCTGGGCTCCACGCAGGGCYAGA | Neonatal hypotonia, Intellectual disability, Seizures, Delayed speech and language development, Global developmental delay, Mental retardation, autosomal dominant 31 |
| 104894371 | PUS1 | NM_001002020.2(PUS1): c.346C>T (p.Arg116Trp) | CCTTCCAGCGCTGCGCCYGGACA | Myopathy, lactic acidosis, and sideroblastic anemia 1 |
| 104894281 | PVRL1 | NM_203285.1(PVRL1): c.554G>A (p.Trp185Ter) | TCCTRGGAAACTCGGTTAAAAGG | Orofacial cleft 7, Cleft lip/palate-ectodermal dysplasia syndrome |
| 267606992 | PVRL4 | NM_030916.2(PVRL4): c.554C>T (p.Thr185Met) | CCCAGCGTGACCTGGGACAYGGA, CCAGCGTGACCTGGGACAYGGAG | Ectodermal dysplasia-syndactyly syndrome 1 |
| 587777572 | PXDN | NM_012293.2(PXDN): c.2638C>T (p.Arg880Cys) | AGCRCACGAAGAACATGCAGCGG | Sclerocornea, autosomal recessive |
| 113993984 | PYGL | NM_002863.4(PYGL): c.2017G>A (p.Glu673Lys) | GGCACCRAAGCCTCGGGGACAGG | Glycogen storage disease, type VI |
| 116987552 | PYGM | NM_005609.2(PYGM): c.148C>T (p.Arg50Ter) | CTCRTGGGGTGGCCACATTGCGG | Glycogen storage disease, type V, not provided |
| 144081869 | PYGM | NM_005609.2(PYGM): c.2056G>A (p.Gly686Arg) | CCAATGGTCAGAGCCCYGTTGAG | Glycogen storage disease, type V |
| 116315896 | PYGM | NM_005609.2(PYGM): c.645G>A (p.Lys215=) | CCTGTGTGTCCACCCAYTTGGCA | Glycogen storage disease, type V, not specified |
| 104893863 | QDPR | NM_000320.2(QDPR): c.68G>A (p.Gly23Asp) | TCTGGRTTCTCGATGCGTGCAGG | Dihydropteridine reductase deficiency |
| 587776734 | RAB39B | NM_171998.3(RAB39B): c.215+1G>A | CCCGGACTGCGCTCCCAYCTGAA, CCGGACTGCGCTCCCAYCTGAAC | Mental retardation, X-linked 72 |
| 587777167 | RAB3GAP2 | NM_012414.3(RAB3GAP2): c.1276C>T (p.Arg426Cys) | CGCRGTACCCTTAGAGACAGAGG | Martsolf syndrome |
| 587777169 | RAB3GAP2 | NM_012414.3(RAB3GAP2): c.3637C>T (p.Arg1213Ter) | TGTCRTACAGAAATAAAATTTGG | Warburg micro syndrome 2 |
| 587777168 | RAB3GAP2 | NM_012414.3(RAB3GAP2): c.1434G>A (p.Trp478Ter) | CCCTGCTGTGTGCTYCACACTTC | Warburg micro syndrome 2 |
| 74315507 | RAC2 | NM_002872.4(RAC2): c.169G>A (p.Asp57Asn) | GTGGRACACTGCTGGGCAGGAGG, GCTGTGGRACACTGCTGGGCAGG | Neutrophil immunodeficiency syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121917739 | RAD51 | NM_002875.4(RAD51): c.449G>A (p.Arg150Gln) | ATTGACCRGGGTGGAGGTGAAGG | Familial cancer of breast |
| 267606997 | RAD51C | NM_058216.2(RAD51C): c.773G>A (p.Arg258His) | CTTCRTACTCGGTTATTAAATGG | Fanconi anemia, complementation group 0, Hereditary cancer-predisposing syndrome |
| 104894284 | RAG1 | NM_000448.2(RAG1): c.1682G>A (p.Arg561His) | GTTCCRCTATGATTCAGCTTTGG | Histiocytic medullary reticulosis |
| 104894285 | RAG1 | NM_000448.2(RAG1): c.1681C>T (p.Arg561Cys) | CCATTGCAAAGAGGTTCYGCTAT | Histiocytic medullary reticulosis |
| 104894298 | RAG1 | NM_000448.2(RAG1): c.1519C>T (p.Arg507Trp) | CCTTTGCATGCCCTTYGGAATGC | Combined cellular and humoral immune defects with granulomas |
| 121918573 | RAG2 | NM_000536.3(RAG2): c.1433G>A (p.Cys478Tyr) | GTATTACTRCAATGAGCATGTGG | |
| 104894633 | RAI1 | NM_030665.3(RAI1): c.5423G>A (p.Ser1808Asn) | TGAGTGCARCAAGGAGGCTCCGG | Smith-Magenis syndrome |
| 527236033 | RAI1 | NM_030665.3(RAI1): c.2273G>A (p.Trp758Ter) | CCCAGGTRGGGATTGCACCCTGG | Smith-Magenis syndrome |
| 104894294 | RAPSN | NM_005055.4(RAPSN): c.490C>T (p.Arg164Cys) | CCATGCTCGAGTGCYGCGTGTGC | MYASTHENIC SYNDROME, CONGENITAL, 11, ASSOCIATED WITH ACETYLCHOLINE RECEPTOR DEFICIENCY |
| 121909127 | RAX | NM_013435.2(RAX): c.575G>A (p.Arg192Gln) | GTGGCRGCGGCAGGAGAAGCTGG | Microphthalmia, isolated 3 |
| 121908280 | RAX2 | NM_032753.3(RAX2): c.260G>A (p.Arg87Gln) | GAGCRGCTGGAGTCAGGCTCGGG, GGAGCRGCTGGAGTCAGGCTCGG | Age-related macular degeneration 6 |
| 587778838 | RB1 | NM_000321.2(RB1): c.2490-1G>A | GACARAATCTTAGTATCAATTGG | Retinoblastoma |
| 587778842 | RB1 | NM_000321.2(RB1): c.763C>T (p.Arg255Ter) | CCTCGAACACCCAGGYGAGGTCA | Retinoblastoma, not provided |
| 587778869 | RB1 | NM_000321.2(RB1): c.103C>T (p.Gln35Ter) | CCTGAGGAGGACCCAGAGYAGGA | Retinoblastoma |
| 137853293 | RB1 | NM_000321.2(RB1): c.2359C>T (p.Arg787Ter) | CCAATACCTCACATTCCTYGAAG | Retinoblastoma, not provided |
| 727503762 | RBCK1 | NM_031229.2(RBCK1): c.553C>T (p.Gln185Ter) | CCAGGAACCCGGACGGGGGYAGC | Polyglucosan body myopathy 1 with or without immunodeficiency |
| 267607000 | RBM10 | NM_005676.4(RBM10): c.1235G>A (p.Trp412Ter) | GGCCCAGTRGGCCATCTCACAGG | TARP syndrome |
| 267607001 | RBM20 | NM_001134363.2(RBM20): c.1901G>A (p.Arg634Gln) | AAGGCCGCRGTCTCGTAGTCCGG | Dilated cardiomyopathy 1DD, Cardiomyopathy |
| 267607004 | RBM20 | NM_001134363.2(RBM20): c.1907G>A (p.Arg636His) | GGTCTCRTAGTCCGGTGAGCCGG | Primary dilated cardiomyopathy, Dilated cardiomyopathy 1DD, Cardiomyopathy |
| 267607003 | RBM20 | NM_001134363.2(RBM20): c.1913C>T (p.Pro638Leu) | CCGCGGTCTCGTAGTCYGGTGAG | Dilated cardiomyopathy 1DD, Cardiomyopathy |
| 146150511 | RBP3 | NM_002900.2(RBP3): c.3238G>A (p.Asp1080Asn) | CCACTGACCTCATGTYGATGATC | Retinitis pigmentosa 66 |
| 386834260 | RD3 | NM_183059.2(RD3): c.296+1G>A | CTCAGRTGAGCACTGGGATGGGG, CCTCAGRTGAGCACTGGGATGGG, TCCTCAGRTGAGCACTGGGATGG | Leber congenital amaurosis 12 |
| 387906272 | RDH12 | NM_152443.2(RDH12): c.658+1G>A | CAAGRTAAGTCTGGAGAAAGAGG | Leber congenital amaurosis 13 |
| 104894470 | RDH12 | NM_152443.2(RDH12): c.565C>T (p.Gln189Ter) | CCCTTCCACGACCTCYAGAGCGA, CCTTCCACGACCTCYAGAGCGAG | Leber congenital amaurosis 13 |
| 104894471 | RDH12 | NM_152443.2(RDH12): c.184C>T (p.Arg62Ter) | CCAGAGAGCTCGCTAGCYGAGGT | Leber congenital amaurosis 13 |
| 121434337 | RDH12 | NM_152443.2(RDH12): c.464C>T (p.Thr155Ile) | CCACTTCCTCCTCAYCTACCTGC | Leber congenital amaurosis 13 |
| 117642173 | RECQL4 | NM_004260.3(RECQL4): c.1391-1G>A | CCTCAGCCGGCGTCTYTGCAGAC | Rothmund-Thomson syndrome |
| 386833851 | RECQL4 | NM_004260.3(RECQL4): c.2476C>T (p.Arg826Ter) | CCTGCAGGGCGAAGACCTGYGAG | Rothmund-Thomson syndrome, Rapadilino syndrome, not provided |
| 760363252 | RECQL4 | NM_004260.3(RECQL4): c.1704+1G>A | CCCATGAGGCCCCAYCTTCTGC, CCATGAGGCCCCAYCTTCTGCA | Rothmund-Thomson syndrome |
| 137853229 | RECQL4 | NM_004260.3(RECQL4): c.2269C>T (p.Gln757Ter) | CCGGGAACGGCGGCGGGTAYAGC | Rothmund-Thomson syndrome |
| 121917740 | REN | NM_000537.3(REN): c.1159C>T (p.Arg387Ter) | CCTGGGGGCCACCTTCATCYGAA | |
| 121917741 | REN | NM_000537.3(REN): c.145C>T (p.Arg49Ter) | CCGAGAAAGCCTGAAGGAAYGAG | Renal dysplasia |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 118203913 | RFT1 | NM_052859.3(RFT1): c.199C>T (p.Arg67Cys) | CCTGGCCAGAGAGGCCTTCYGCA, CCAGAGAGGCCTTCYGCAGAGCA | Congenital disorder of glycosylation type 1N |
| 137853099 | RFX5 | NM_000449.3(RFX5): c.446G>A (p.Arg149Gln) | GCTCRAAGGCTTGGTGGCCGGGG, AGCTCRAAGGCTTGGTGGCCGGG, AAGCTCRAAGGCTTGGTGGCCGG | Bare lymphocyte syndrome type 2, complementation group E |
| 267607013 | RFX6 | NM_173560.3(RFX6): c.542G>A (p.Arg181Gln) | ACAAGGCRGCTTGGAACAAGAGG | Mitchell-Riley syndrome |
| 121918587 | RHAG | NM_000324.2(RHAG): c.836G>A (p.Gly279Glu) | CTTGCTGRAGGAGTTGCTGTGGG, CCTTGCTGRAGGAGTTGCTGTGG | |
| 387907130 | RHBDF2 | NM_024599.5(RHBDF2): c.566C>T (p.Pro189Leu) | CCCTTCCAGATTGTGGATCYGCT, CCTTCCAGATTGTGGATCYGCTG, CCAGATTGTGGATCYGCTGGCCC | Howel-Evans syndrome |
| 104893780 | RHO | NM_000539.3(RHO): c.544G>A (p.Gly182Ser) | GAGRGCCTGCAGTGCTCGTGTGG | Retinitis pigmentosa 4 |
| 527236103 | RHO | NM_000539.3(RHO): c.520G>A (p.Gly174Ser) | TCGCCRGCTGGTCCAGGTAATGG | Retinitis pigmentosa |
| 104893769 | RHO | NM_000539.3(RHO): c.50C>T (p.Thr17Met) | CCCTTCTCCAATGCGAYGGGTGT, CCTTCTCCAATGCGAYGGGTGTG | Retinitis pigmentosa 4 |
| 104893778 | RHO | NM_000539.3(RHO): c.1030C>T (p.Gln344Ter) | CCAAGACGGAGACGAGCYAGGTG | Retinitis pigmentosa 4 |
| 104893781 | RHO | NM_000539.3(RHO): c.800C>T (p.Pro267Leu) | CCTGATCTGCTGGGTGCYCTACG | Retinitis pigmentosa 4 |
| 104893794 | RHO | NM_000539.3(RHO): c.511C>T (p.Pro171Ser) | CCTGCGCCGCACCCYCACTCGCC | Retinitis pigmentosa 4 |
| 76857106 | RNASEH2A | NM_006397.2(RNASEH2A): c.109G>A (p.Gly37Ser) | GCGRGCAGGGGCCCCGTGCTGGG, GGCGRGCAGGGGCCCCGTGCTGG | Aicardi Goutieres syndrome 4 |
| 75718910 | RNASEH2A | NM_006397.2(RNASEH2A): c.704G>A (p.Arg235Gln) | TGTCCRGTTCAGCTGGCGCACGG | Aicardi Goutieres syndrome 4 |
| 397515479 | RNASEH2A | NM_006397.2(RNASEH2A): c.75C>T (p.Arg25=) | CCCGCGGTGTGCCGYAAGGAGCC | Aicardi Goutieres syndrome 4 |
| 786201014 | RNF125 | NM_017831.3(RNF125): c.336G>A (p.Met112Ile) | GTGAAATRAGGGCACATATTCGG | TENORIO SYNDROME |
| 370242930 | RNF125 | NM_017831.3(RNF125): c.520C>T (p.Arg174Cys) | CCAGTTCTGTCCACTTTGCYGTT | TENORIO SYNDROME |
| 121918162 | RNF135 | NM_032322.3(RNF135): c.857G>A (p.Arg286His) | ACCRCCCACAACCCTATCGCTGG | Macrocephaly, macrosomia, facial dysmorphism syndrome |
| 397514478 | RNF170 | NM_001160223.1(RNF170): c.595C>T (p.Arg199Cys) | CCTTTTCTGGATGTTTYGCATCA | Ataxia, sensory, autosomal dominant |
| 121918278 | ROBO3 | NM_022370.3(ROBO3): c.2317C>T (p.Gln773Ter) | CCCCCAGTGGCCCCCCAYAGGGA, CCCCAGTGGCCCCCCAYAGGGAG, CCCAGTGGCCCCCCAYAGGGAGT, CCAGTGGCCCCCCAYAGGGAGTG | Gaze palsy, familial horizontal, with progressive scoliosis |
| 121909083 | ROR2 | NM_004560.3(ROR2): c.1504C>T (p.Gln502Ter) | CCCCGGGGGAGCAGACCYAGGCT, CCGGGGGAGCAGACCYAGGCTG, CCGGGGGAGCAGACCYAGGCTGT | Robinow syndrome, autosomal recessive |
| 121909084 | ROR2 | NM_004560.3(ROR2): c.550C>T (p.Arg184Cys) | CCGGGGAATTGCCTGTGCAYGCT | Robinow syndrome, autosomal recessive |
| 267607016 | ROR2 | NM_004560.3(ROR2): c.1324C>T (p.Arg442Ter) | CCACACCGCAGCGGYGACAGCTG | Robinow syndrome, autosomal recessive, with brachy-syn-polydactyly |
| 104894927 | RP2 | NM_006915.2(RP2): c.358C>T (p.Arg120Ter) | CCAACAATTTCGTGTGYGAGATT | Retinitis pigmentosa 2 |
| 61751281 | RPE65 | NM_000329.2(RPE65): c.118G>A (p.Gly40Ser) | ACCRGCAGTCTCCTTCGATGTGG | Retinitis pigmentosa, not provided |
| 61752871 | RPE65 | NM_000329.2(RPE65): c.271C>T (p.Arg91Trp) | CCGCACTGATGCTTACGTAYGGG | Retinitis pigmentosa 20, not provided |
| 62638651 | RPGR | NM_000328.2(RPGR): c.703C>T (p.Pro235Ser) | CCTGGGCAATCACAGAACAYCCC | Retinitis pigmentosa 15, not provided |
| 121918204 | RPGRIP1L | NM_015272.3(RPGRIP1L): c.2050C>T (p.Gln684Ter) | CCCTTGAGGTCCACYAGGCTTAT | Joubert syndrome 7 |
| 121918591 | RPIA | NM_144563.2(RPIA): c.404C>T (p.Ala135Val) | CCCTGTCCTCCGCAGGYCCGCCA, CCTGTCCTCCGCAGGYCCGCCAG | Deficiency of ribose-5-phosphate isomerase |
| 587777527 | RPL21 | NM_000982.3(RPL21): c.95G>A (p.Arg32Gln) | TATATGCRAATCTATAAGAAAGG | Hypotrichosis 12 |
| 786200936 | RPS19 | NM_001022.3(RPS19): c.380G>A (p.Gly127Glu) | ACCTCAGGRACAAAGAGATCTGG | Diamond-Blackfan anemia 1 |
| 104894711 | RPS19 | NM_001022.3(RPS19): c.184C>T (p.Arg62Trp) | CCCCCAGCTTCCACAGCGYGGCA, CCCCAGCTTCCACAGCGYGGCAC, CCAGCTTCCACAGCGYGGCACCT | Diamond-Blackfan anemia 1 |
| 61762293 | RPS19 | NM_001022.3(RPS19): c.280C>T (p.Arg94Ter) | CCCAGCCACTTCAGCYGAGGCTC, CCAGCCACTTCAGCYGAGGCTCC | Diamond-Blackfan anemia 1 |
| 148622862 | RPS26 | NM_001029.3(RPS26): c.3+1G>A | AGATGRTGAGTCTTCTTGCGTGG | Diamond-Blackfan anemia 10 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 122454128 | RPS6KA3 | NM_004586.2(RPS6KA3): c.2065C>T (p.Gln689Ter) | CCAACTGCCACAATACYAACTAA | Coffin-Lowry syndrome |
| 397507554 | RPS7 | NM_001011.3(RPS7): c.147+1G>A | AAGRTAAGCTGGCGCTCCCTCGG | Diamond-Blackfan anemia 8 |
| 397514759 | RPSA | NM_002295.5(RPSA): c.25C>T (p.Gln9Ter) | CCCTTGATGTCCTGYAAATGAAG | Splenic hypoplasia |
| 515726181 | RRM2B | NM_015713.4(RRM2B): c.121C>T (p.Arg41Trp) | ACCRGCGAGAACTCTTTCTTAGG | RRM2B-related mitochondrial disease |
| 267607025 | RRM2B | NM_015713.4(RRM2B): c.329G>A (p.Arg110His) | GGTGGAGCRCTTTAGTCAGGAGG | Mitochondrial DNA depletion syndrome 8B (MNGIE type), RRM2B-related mitochondrial disease |
| 515726192 | RRM2B | NM_015713.4(RRM2B): c.583G>A (p.Gly195Arg) | CCTGAGAAGAAAACTCYTTCTAC | RRM2B-related mitochondrial disease |
| 515726195 | RRM2B | NM_015713.4(RRM2B): c.632G>A (p.Arg211Lys) | CCTGGCATAAGACCTYTCTTCTT | RRM2B-related mitochondrial disease |
| 200382776 | RSPH1 | NM_080860.3(RSPH1): c.727+5G>A (p.Ala244ValfsTer22) | CCACAGCCCGGGGGTGCCCYACA | Kartagener syndrome |
| 587777635 | RSPH1 | NM_080860.3(RSPH1): c.281G>A (p.Trp94Ter) | CCGCAGGTCATTTGCCYACTCTC | Primary ciliary dyskinesia 24 |
| 118204041 | RSPH4A | NM_001010892.2(RSPH4A): c.460C>T (p.Gln154Ter) | CCTTTCAACAGTCTYAGCAACCC | Ciliary dyskinesia, primary, 11 |
| 118204042 | RSPH4A | NM_001010892.2(RSPH4A): c.325C>T (p.Gln109Ter) | CCTCGCGGCACCACCTYAGTCGG | Ciliary dyskinesia, primary, 11 |
| 74315423 | RSPO4 | NM_001029871.3(RSPO4): c.218G>A (p.Cys73Tyr) | GACTRTCCCCCTGGGTACTTCGG | Anonychia |
| 387907027 | RSPO4 | NM_001029871.3(RSPO4): c.190C>T (p.Arg64Cys) | CCGCCGGGAAGGCATCYGCCAGT | Anonychia |
| 397515537 | RUNX2 | NM_001024630.3(RUNX2): c.1171C>T (p.Arg391Ter) | CCGCTTCTCCAACCCAYGAATGC | Cleidocranial dysostosis |
| 193922802 | RYR1 | NM_000540.2(RYR1): c.7048G>A (p.Ala2350Thr) | AGAACRCCAATGTGGTGGTGCGG | Malignant hyperthermia susceptibility type 1, not provided |
| 193922879 | RYR1 | NM_000540.2(RYR1): c.14524G>A (p.Val4842Met) | GACCRTGGGCCTTCTGGCGGTGG, GATGACCRTGGGCCTTCTGGCGG | Minicore myopathy with external ophthalmoplegia, Myopathy, congenital with cores, not provided |
| 794727982 | RYR1 | NM_000540.2(RYR1): c.12612G>A (p.Trp4204Ter) | GTGRGAGATGCCCCAGGTCAGGG, AGTGRGAGATGCCCCAGGTCAGG | Malignant hyperthermia susceptibility type 1, Central core disease |
| 121918594 | RYR1 | NM_000540.2(RYR1): c.7373G>A (p.Arg2458His) | CCTCCRCTCCCTTGTGCCCTTGG | Malignant hyperthermia susceptibility type 1, Central core disease, not provided |
| 118192183 | RYR1 | NM_000540.2(RYR1): c.14696G>A (p.Gly4899Glu) | AGGCATTGRGGACGAGATCGAGG | Central core disease, not provided |
| 118192125 | RYR1 | NM_000540.2(RYR1): c.8816G>A (p.Arg2939Lys) | GTTACAARGCACGCGGGTTGGGG, GGTTACAARGCACGCGGGTTGGG | Central core disease, not provided |
| 118192168 | RYR1 | NM_000540.2(RYR1): c.14545G>A (p.Val4849Ile) | GGTCRTCTACCTGTACACCGTGG | Minicore myopathy with external ophthalmoplegia, not provided |
| 193922781 | RYR1 | NM_000540.2(RYR1): c.5183C>T (p.Ser1728Phe) | CCTGCCGCAGCCGCCGCTYCATG, CCGCAGCCGCCGCTYCATGCTCT | Malignant hyperthermia susceptibility type 1, not provided |
| 148772854 | RYR1 | NM_000540.2(RYR1): c.11941C>T (p.His3981Tyr) | CCAGCAGAGCCTGGCGYACAGTC | Minicore myopathy with external ophthalmoplegia, not specified |
| 118192147 | RYR1 | NM_000540.2(RYR1): c.14659C>T (p.His4887Tyr) | CCCTCAGTGTTACCTGTTTYACA, CCTCAGTGTTACCTGTTTYACAT | Central core disease, not provided |
| 118192164 | RYR1 | NM_000540.2(RYR1): c.10579C>T (p.Pro3527Ser) | CCTGAATATGTGTGCGYCCACCG | not provided |
| 118192173 | RYR1 | NM_000540.2(RYR1): c.325C>T (p.Arg109Trp) | CCATGCCATCCTGCTCYGGCATG | Minicore myopathy with external ophthalmoplegia, not provided |
| 118192181 | RYR1 | NM_000540.2(RYR1): c.14581C>T (p.Arg4861Cys) | CCTTCAACTTCTTCYGCAAGTTC | Central core disease, not provided |
| 587784376 | RYR1 | NM_000540.2(RYR1): c.4225C>T (p.Arg1409Ter) | CCACCCCCACGCTGCCCYGACTC, CCCCCACGCTGCCCYGACTCCCT | not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 118192134 | RYR1 | NM_000540.2(RYR1): c.13910C>T (p.Thr4637Ile) | CCTGGAGGAAAGCAYAGGCTACA | Central core disease, not provided |
| 118192140 | RYR1 | NM_000540.2(RYR1): c.14126C>T (p.Thr4709Met) | CCGACTGGTGCTCAACAYGCCGT | Minicore myopathy with external ophthalmoplegia, Central core disease, not provided |
| 794728710 | RYR2 | NM_001035.2(RYR2): c.689G>A (p.Gly230Asp) | TCATTGRTGGTGATGTCCTCAGG | not provided |
| 794728805 | RYR2 | NM_001035.2(RYR2): c.14465G>A (p.Arg4822His) | TTCRTGCTGGAGGAGGGATCGGG, GTTCRTGCTGGAGGAGGGATCGG | not provided |
| 794728754 | RYR2 | NM_001035.2(RYR2): c.7160C>T (p.Ala2387Val) | CCACATGGGGAACGYGATCATGA | not provided |
| 121918600 | RYR2 | NM_001035.2(RYR2): c.13489C>T (p.Arg4497Cys) | CCCTCAGAACTATTTTGCTYGCA, CCTCAGAACTATTTTGCTYGCAA | Catecholaminergic polymorphic ventricular tachycardia |
| 764698152 | RYR2 | NM_001035.2(RYR2): c.1240C>T (p.Arg414Cys) | CCCAGCATGAAGAATCAYGCACA, CCAGCATGAAGAATCAYGCACAG | not provided |
| 79681911 | SAA1 | NM_000331.4(SAA1): c.269G>A (p.Gly90Asp) | CCATGRTGCGGAGGACTCGCTGG | |
| 281865119 | SACS | NM_014363.5(SACS): c.10907G>A (p.Arg3636Gln) | GAACRAATGGATTTGTTATCTGG | Spastic ataxia Charlevoix-Saguenay type |
| 281865120 | SACS | NM_014363.5(SACS): c.12160C>T (p.Gln4054Ter) | CCTGCTTTGAAAAGCTTYAAACA | Spastic ataxia Charlevoix-Saguenay type |
| 587777209 | SAG | NM_000541.4(SAG): c.523C>T (p.Arg175Ter) | CCCACAGGAGCTCCGTGYGATTA, CCACAGGAGCTCCGTGYGATTAC | Oguchi disease |
| 104894538 | SALL1 | NM_002968.2(SALL1): c.967C>T (p.Gln323Ter) | CCCCAATCCAGCTACCTYAGAG, CCCCAATCCAGCTACCTYAGAGC, CCAATCCAGCTACCTYAGAGCA, CCAATCCAGCTACCTYAGAGCAG | Townes-Brocks-branchiootorenal-like syndrome |
| 515726145 | SAMHD1 | NM_015474.3(SAMHD1): c.434G>A (p.Arg145Gln) | CCCAGCTGTTTGATGTATYGAAG, CCAGCTGTTTGATGTATYGAAGA | Aicardi Goutieres syndrome 5 |
| 267607027 | SAMHD1 | NM_015474.3(SAMHD1): c.490C>T (p.Arg164Ter) | CCAGGAGCTTCACACAATYGATT | Aicardi Goutieres syndrome 5 |
| 121434517 | SAMHD1 | NM_015474.3(SAMHD1): c.433C>T (p.Arg145Ter) | CCTCAATTTCAACGTCTTYGATA | Aicardi Goutieres syndrome 5 |
| 121434519 | SAMHD1 | NM_015474.3(SAMHD1): c.1642C>T (p.Gln548Ter) | CCAGAGAAATTTGCAGAGYAGCT | Aicardi Goutieres syndrome 5 |
| 200053119 | SCARB2 | NM_005506.3(SCARB2): c.361C>T (p.Arg121Ter) | TTGGTCTCRTTCAAAAACATAGG | not provided |
| 387907086 | SCARF2 | NM_153334.6(SCARF2): c.773G>A (p.Cys258Tyr) | GGCACGTRTGCCTGCGAGCCGGG, CGGCACGTRTGCCTGCGAGCCGG | Marden Walker like syndrome |
| 138607170 | SCN11A | NM_001287223.1(SCN11A): c.673C>T (p.Arg225Cys) | AACACACRGAAGGTACGCAGGGG, GAACACACRGAAGGTACGCAGGG | Episodic pain syndrome, familial, 3 |
| 794726716 | SCN1A | NM_001165963.1(SCN1A): c.2876G>A (p.Cys959Tyr) | TGGGACTRTATGGAGGTTGCTGG | Severe myoclonic epilepsy in infancy |
| 794726824 | SCN1A | NM_001165963.1(SCN1A): c.965-1G>A | AACARGATATCATTATTTCCTGG | Severe myoclonic epilepsy in infancy, not provided |
| 794726828 | SCN1A | NM_001165963.1(SCN1A): c.2929G>A (p.Val977Met) | CATGRTGATTGGAAACCTAGTGG | Severe myoclonic epilepsy in infancy |
| 796052972 | SCN1A | NM_001165963.1(SCN1A): c.1153G>A (p.Glu385Lys) | CTGGRAAATCTTTATCAACTGG | not provided |
| 121917957 | SCN1A | NM_006920.4(SCN1A): c.1130G>A (p.Arg377Gln) | CTTGTTTCRACTAATGACTCAGG | Severe myoclonic epilepsy in infancy, Generalized epilepsy with febrile seizures plus, type 1, not provided |
| 121917971 | SCN1A | NM_006920.4(SCN1A): c.2804G>A (p.Arg935His) | TCCVCGTGCTGTGTGGGGAGTGG, TGTGTTCCVCGTGCTGTGTGGGG | Severe myoclonic epilepsy in infancy |
| 398123588 | SCN1A | NM_006920.4(SCN1A): c.2543G>A (p.Arg848His) | TGTTCTCCRTTCATTTCGATTGG | Severe myoclonic epilepsy in infancy, Generalized epilepsy with febrile seizures plus, type 2 |
| 763400390 | SCN1A | NM_001165963.1(SCN1A): c.2177-1G>T | CCTGGATTCTTCAAGTTHTAGAT | not provided |
| 794726736 | SCN1A | NM_001165963.1(SCN1A): c.1738C>T (p.Arg580Ter) | CCTTTTCAGCTTTAGAGGYGAG | Severe myoclonic epilepsy in infancy |
| 794726766 | SCN1A | NM_001165963.1(SCN1A): c.2303C>T (p.Pro768Leu) | CCTGGTTGTGATGGACCYATTTG | Severe myoclonic epilepsy in infancy |
| 794726778 | SCN1A | NM_001165963.1(SCN1A): c.1834C>T (p.Arg612Ter) | CCTTGTTTGTGCCCYGACGACAC | Severe myoclonic epilepsy in infancy |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 796052955 | SCN1A | NM_001165963.1(SCN1A): c.311C>T (p.Ala104Val) | CCATCTTCCGGTTCAGTGYCACC | not provided |
| 796053089 | SCN1A | NM_001165963.1(SCN1A): c.314C>T (p.Thr105Ile) | CCGGTTCAGTGCCAYCTCTGCCC | not provided |
| 121917984 | SCN1A | NM_006920.4(SCN1A): c.677C>T (p.Thr226Met) | CCGAGCATTGAAGABGATTTCAG | Severe myoclonic epilepsy in infancy, not provided |
| 794726730 | SCN1A | NM_001165963.1(SCN1A): c.2134C>T (p.Arg712Ter) | CCTTCCCAAAGGCAAYGAGCAAT | Severe myoclonic epilepsy in infancy, Generalized epilepsy with febrile seizures plus, type 2, not provided |
| 794726838 | SCN1A | NM_001165963.1(SCN1A): c.1970C>T (p.Pro657Leu) | CCTTGGTTGGTGGACYTTCAGTT | Severe myoclonic epilepsy in infancy |
| 786205835 | SCN1B | NM_001037.4(SCN1B): c.449-1G>A | CCCTGCARCCAACAGAGACATGG | not provided |
| 786205837 | SCN1B | NM_001037.4(SCN1B): c.73G>A (p.Asp25Asn) | GGAGGTGRACTCGGAGACCGAGG | not provided |
| 16969925 | SCN1B | NM_001037.4(SCN1B): c.254G>A (p.Arg85His) | TGAGCRCTTCGAGGGCCGCGTGG | Atrial fibrillation, familial, 13 |
| 794727152 | SCN2A | NM_021007.2(SCN2A): c.2558G>A (p.Arg853Gln) | TTCCRGCTGGTAAATTAACTGGG, ATTCCRGCTGGTAAATTAACTGG | Early infantile epileptic encephalopathy 11, not provided |
| 121917751 | SCN2A | NM_021007.2(SCN2A): c.2674G>A (p.Val892Ile) | CATCRTCTTCATTTTTGCTGTGG | Benign familial neonatal-infantile seizures, not provided |
| 121917753 | SCN2A | NM_021007.2(SCN2A): c.3956G>A (p.Arg1319Gln) | GTCCCRGTTTGAAGGAATGAGGG, TGTCCCRGTTTGAAGGAATGAGG | Benign familial neonatal-infantile seizures, not provided |
| 796053197 | SCN2A | NM_021007.2(SCN2A): c.2809C>T (p.Arg937Cys) | CCTTCCTGATCGTGTTCYGCGTG | not provided |
| 121917749 | SCN2A | NM_001040142.1(SCN2A): c.3988C>T (p.Leu1330Phe) | CCAGGTTGTTGTAAATGCTYTTT | Benign familial neonatal-infantile seizures |
| 587777558 | SCN3B | NM_018400.3(SCN3B): c.17G>A (p.Arg6Lys) | CCAGGGGAAACAATYTATTGAAG | Atrial fibrillation, familial, 16 |
| 121908545 | SCN4A | NM_000334.4(SCN4A): c.4343G>A (p.Arg1448His) | TCCRTGTGATCCGCCTGGCGCGG, GCTGTTCCRTGTGATCCGCCTGG | Paramyotonia congenita of von Eulenburg |
| 121908557 | SCN4A | NM_000334.4(SCN4A): c.2024G>A (p.Arg675Gln) | GCAGCTGCRGGTCTTCAAGCTGG | Normokalemic periodic paralysis, potassium-sensitive |
| 80338789 | SCN4A | NM_000334.4(SCN4A): c.3395G>A (p.Arg1132Gln) | TGCRGGCCCTGCGTCCCCTGAGG | Hypokalemic periodic paralysis 1, Hypokalemic periodic paralysis, type 2 |
| 80338784 | SCN4A | NM_000334.4(SCN4A): c.2006G>A (p.Arg669His) | TGTGCTACRCTCCTTCCGTCTGG | Hypokalemic periodic paralysis 1, Hypokalemic periodicparalysis, type 2 |
| 527236148 | SCN4A | NM_000334.4(SCN4A): c.664C>T (p.Arg222Trp) | CAGCACCCRGAAGGTCCTCAGGG | Hypokalemic periodic paralysis, type 2 |
| 121908555 | SCN4A | NM_000334.4(SCN4A): c.3472C>T (p.Pro1158Ser) | CCCTCCTAGGCGCCATCYCCTCC, CCTCCTAGGCGCCATCYCCTCCA | Hypokalemic periodic paralysis, type 2 |
| 794728858 | SCN5A | NM_198056.2(SCN5A): c.1891-1G>A | CACTCARCCACGCCATCGGAGG | not provided |
| 794728926 | SCN5A | NM_198056.2(SCN5A): c.1122G>A (p.Trp374Ter) | CTGRGAGCGCCTCTATCAGCAGG | not provided |
| 794728933 | SCN5A | NM_198056.2(SCN5A): c.3840+5G>A | CGTGARTGTGGGCACCCGAAGGG, ACGTGARTGTGGGCACCCGAAGG | not provided |
| 199473047 | SCN5A | NM_000335.4(SCN5A): c.128G>A (p.Arg43Gln) | GAGCCRAGAGGGGCTGCCCGAGG | Congenital long QT syndrome |
| 199473048 | SCN5A | NM_198056.2(SCN5A): c.142G>A (p.Glu48Lys) | TGCCCRAGGAGGAGGCTCCCCGG | Congenital long QT syndrome, not provided |
| 199473084 | SCN5A | NM_000335.4(SCN5A): c.865G>A (p.Gly289Ser) | CAACRGCACCAACGGCTCCGTGG | Long QT syndrome, Congenital long QT syndrome |
| 199473085 | SCN5A | NM_198056.2(SCN5A): c.874G>A (p.Gly292Ser) | AACRGCTCCGTGGAGGCCGACGG | Brugada syndrome, not provided |
| 199473086 | SCN5A | NM_000335.4(SCN5A): c.880G>A (p.Val294Met) | CTCCRTGGAGGCCGACGGCTTGG | Brugada syndrome |
| 199473088 | SCN5A | NM_000335.4(SCN5A): c.898G>A (p.Val300Ile) | CGGCTTGRTCTGGGAATCCCTGG | Brugada syndrome |
| 199473101 | SCN5A | NM_198056.2(SCN5A): c.1127G>A (p.Arg376His) | CTGGGAGCRCCTCTATCAGCAGG | Brugada syndrome, not provided |
| 199473110 | SCN5A | NM_000335.4(SCN5A): c.1237G>A (p.Ala413Thr) | CGTGGTCRCAATGGCCTATGAGG | Congenital long QT syndrome |
| 199473138 | SCN5A | NM_000335.4(SCN5A): c.1960G>A (p.Glu654Lys) | GCTTCRAGGAGCCAGGAGCACGG | Congenital long QT syndrome |
| 199473159 | SCN5A | NM_000335.4(SCN5A): c.2365G>A (p.Val789Ile) | CATCRTCATCCTTAGCCTCATGG | Brugada syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199473172 | SCN5A | NM_000335.4(SCN5A): c.2678G>A (p.Arg893His) | TCCDCATCCTCTGTGGAGAGTGG | Brugada syndrome |
| 199473195 | SCN5A | NM_000335.4(SCN5A): c.3337G>A (p.Asp1113Asn) | AGGCCRACTGGCGGCAGCAGTGG | Congenital long QT syndrome |
| 199473206 | SCN5A | NM_198056.2(SCN5A): c.3695G>A (p.Arg1232Gln) | AGAGGAGCRGAAGACCATCAAGG | Brugada syndrome, not provided |
| 199473233 | SCN5A | NM_198056.2(SCN5A): c.4057G>A (p.Val1353Met) | TGGGCRTGAACCTCTTTGCGGGG, ATGGGCRTGAACCTCTTTGCGGG, CATGGGCRTGAACCTCTTTGCGG | Brugada syndrome, not provided |
| 199473294 | SCN5A | NM_198056.2(SCN5A): c.5038G>A (p.Ala1680Thr) | CTTCRCTTATGTCAAGTGGGAGG, CAACTTCRCTTATGTCAAGTGGG, CCAACTTCRCTTATGTCAAGTGG | Brugada syndrome, Sudden cardiac death, not provided |
| 199473341 | SCN5A | NM_000335.4(SCN5A): c.3832G>A (p.Val1278Ile) | CTCATCRTAGACGTGAGTGTGGG, CCTCATCRTAGACGTGAGTGTGG | Primary dilated cardiomyopathy, Dilated cardiomyopathy, not provided |
| 199473552 | SCN5A | NM_000335.4(SCN5A): c.103G>A (p.Gly35Ser) | CCGCRGCTCAACCACCTTGCAGG | Brugada syndrome |
| 199473572 | SCN5A | NM_000335.4(SCN5A): c.1384G>A (p.Glu462Lys) | CTCCTTGRAGATGTCCCCTTTGG | Long QT syndrome, Congenital long QT syndrome, not provided |
| 199473582 | SCN5A | NM_000335.4(SCN5A): c.2236G>A (p.Glu746Lys) | TTCRAGGAGATGCTGCAGGTCGG, TGAATTCRAGGAGATGCTGCAGG | Brugada syndrome |
| 199473584 | SCN5A | NM_198056.2(SCN5A): c.2441G>A (p.Arg814Gln) | CCAGCTGCRGGTCTTCAAGCTGG | Brugada syndrome |
| 199473595 | SCN5A | NM_000335.4(SCN5A): c.3553G>A (p.Ala1185Thr) | CACAGRCCCCAGGGAAGGTCTGG | Congenital long QT syndrome, not specified |
| 199473605 | SCN5A | NM_198056.2(SCN5A): c.4018G>A (p.Val1340Ile) | TCCTCRTCTGCCTCATCTTCTGG | Brugada syndrome, not provided |
| 199473637 | SCN5A | NM_000335.4(SCN5A): c.5800G>A (p.Gly1934Ser) | GGGCAGCRGCCTCTCCGAAGAGG | Brugada syndrome |
| 778522112 | SCN5A | NM_198056.2(SCN5A): c.1880C>T (p.Pro627Leu) | GGCRGGTGCTCTAGCATCACAGG | not provided |
| 137854601 | SCN5A | NM_198056.2(SCN5A): c.5350G>A (p.Glu1784Lys) | GAGCACCRAGCCCCTGAGTGAGG | Long QT syndrome 3, Brugada syndrome 1, Sinus node disease, Congenital long QT syndrome, not provided |
| 187531872 | SCN5A | NM_198056.2(SCN5A): c.998+5G>A | CCCGGGGTGGTAGGTGCCAYATA, CCGGGGTGGTAGGTGCCAYATAC | Arrhythmogenic right ventricular cardiomyopathy, not specified, not provided |
| 794728877 | SCN5A | NM_198056.2(SCN5A): c.3994C>T (p.Pro1332Ser) | CCCTGGTGGGCGCCATCYCGTCC, CCTGGTGGGCGCCATCYCGTCCA | not provided |
| 199473072 | SCN5A | NM_000335.4(SCN5A): c.673C>T (p.Arg225Trp) | CCTTCCGAGTCCTCYGGGCCCTG | Congenital long QT syndrome, Cardiac conduction defect, nonspecific, not provided |
| 199473097 | SCN5A | NM_198056.2(SCN5A): c.1099C>T (p.Arg367Cys) | CCTTTCTTGCACTCTTCYGCCTG | Congenital long QT syndrome, not provided |
| 199473133 | SCN5A | NM_000335.4(SCN5A): c.1855C>T (p.Leu619Phe) | CCCCAGGAAGCCACCTCYTCCGC, CCCAGGAAGCCACCTCYTCCGCC, CCAGGAAGCCACCTCYTCCGCCC | Brugada syndrome, Long QT syndrome |
| 199473134 | SCN5A | NM_000335.4(SCN5A): c.1895C>T (p.Thr632Met) | CCTGATTGCACTCAGACCAYGCC | Brugada syndrome |
| 199473139 | SCN5A | NM_000335.4(SCN5A): c.1981C>T (p.Arg661Trp) | CCAGGAGCACGGCAGYGGGCCCT | Brugada syndrome |
| 199473171 | SCN5A | NM_198056.2(SCN5A): c.2677C>T (p.Arg893Cys) | CCTTCCTCATCATCTTCYGCATC | Brugada syndrome, not provided |
| 199473192 | SCN5A | NM_000335.4(SCN5A): c.3296C>T (p.Ala1099Val) | CCTGGAGCCAGGTGTCAGYGACT | Long QT syndrome, Congenital long QT syndrome, not provided |
| 199473194 | SCN5A | NM_000335.4(SCN5A): c.3335C>T (p.Ala1112Val) | CCAGTGCATCTCAGGYCGACTGG | Brugada syndrome |
| 199473197 | SCN5A | NM_198056.2(SCN5A): c.3392C>T (p.Thr1131Ile) | CCACACCCTGTCCATAGAYCCC, CCCCTGTCCATAGAYCCCAGAGG | Atrial fibrillation, not provided |
| 199473200 | SCN5A | NM_000335.4(SCN5A): c.3520C>T (p.Arg1174Cys) | CCATAGGCTGTGTCCGGYGCTG, CCATAGGCTGTGTCCGGYGCTGT | Congenital long QT syndrome |
| 199473225 | SCN5A | NM_198056.2(SCN5A): c.3995C>T (p.Pro1332Leu) | CCCTGGTGGGCGCCATCCBGTCC, CCTGGTGGGCGCCATCCBGTCCA | Brugada syndrome, not provided |
| 199473288 | SCN5A | NM_198056.2(SCN5A): c.4934C>T (p.Thr1645Met) | CCAAGGGGATCCGCAYGCTGCTC | Congenital long QT syndrome, not provided |
| 199473561 | SCN5A | NM_000335.4(SCN5A): c.677C>T (p.Ala226Val) | CCTTCCGAGTCCTCCGGGYCCTG, CCGAGTCCTCCGGGYCCTGAAAA | Brugada syndrome |
| 199473576 | SCN5A | NM_198056.2(SCN5A): c.1705C>T (p.Arg569Trp) | CCCTGGCCCTGCGCBGGACCAG, CCTGGCCCTGCGCBGGACCAGT | Congenital long QT syndrome, not provided |
| 199473577 | SCN5A | NM_000335.4(SCN5A): c.1858C>T (p.Arg620Cys) | CCCAGGAAGCCACCTCCTCYGCC, CCAGGAAGCCACCTCCTCYGCCC | Brugada syndrome |
| 199473580 | SCN5A | NM_000335.4(SCN5A): c.2065C>T (p.Arg689Cys) | CCACCATGCTGGAACYGTCTCGC | Congenital long QT syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199473603 | SCN5A | NM_000335.4(SCN5A): c.3908C>T (p.Thr1303Met) | CCCATCAAGTCACTGCGGAYGCT, CCATCAAGTCACTGCGGAYGCTG | Long QT syndrome, Congenital long QT syndrome, not provided |
| 199473640 | SCN5A | NM_198056.2(SCN5A): c.6034C>T (p.Arg2012Cys) | CCCTTCTCCGGACAGGGACYGTG, CCTTCTCCGGACAGGGACYGTGA | Congenital long QT syndrome, not provided |
| 192113333 | SCN5A | NM_198056.2(SCN5A): c.553G>A (p.Ala185Thr) | CCCGAAGGAAAGTGAACGYGTGC, CCGAAGGAAAGTGAACGYGTGCA | Congenital long QT syndrome, not provided |
| 769292594 | SCN5A | NM_198056.2(SCN5A): c.1706G>A (p.Arg569Gln) | CCCTGGGCACTGGTCYGGCGCAG, CCTGGGCACTGGTCYGGCGCAGG | not provided |
| 137854602 | SCN5A | NM_000335.4(SCN5A): c.4531C>T (p.Arg1511Trp) | CCCCAGAAGCCCATCCCAYGGCC, CCCAGAAGCCCATCCCAYGGCCC, CCAGAAGCCCATCCCAYGGCCCC | Brugada syndrome 1, Primary familial hypertrophic cardiomyopathy, not provided |
| 137854604 | SCN5A | NM_000335.4(SCN5A): c.5126C>T (p.Ser1709Leu) | CCAGATCACCACGTYGGCCGGCT | Brugada syndrome 1, Ventricular fibrillation, Paroxysmal familial ventricular fibrillation, not provided |
| 587777721 | SCN8A | NM_014191.3(SCN8A): c.4850G>A (p.Arg1617Gln) | CCTATTCCRAGTCATCCGATTGG | Early infantile epileptic encephalopathy 13 |
| 587780586 | SCN8A | NM_014191.3(SCN8A): c.2549G>A (p.Arg850Gln) | TTAGCTCCRAGTCTTCAAATTGG | Early infantile epileptic encephalopathy 13, not provided |
| 137852635 | SCNN1A | NM_001038.5(SCNN1A): c.1685C>T (p.Ser562Leu) | CCTGTGGTTCGGCTCCTYGGTGT | Pseudohypoaldosteronism type 1 autosomal recessive |
| 137852708 | SCNN1B | NM_000336.2(SCNN1B): c.1849C>T (p.Pro617Ser) | CCCATCCCAGGCACCCCGYCCCC, CCATCCCAGGCACCCCGYCCCCC | Pseudoprimary hyperaldosteronism |
| 5738 | SCNN1G | NM_001039.3(SCNN1G): c.589G>A (p.Glu197Lys) | ATCRAGTCCAAGCAAGTGGTGGG, CATCRAGTCCAAGCAAGTGGTGG, GCACATCRAGTCCAAGCAAGTGG | Bronchiectasis with or without elevated sweat chloride 3 |
| 137853342 | SCNN1G | NM_001039.3(SCNN1G): c.1718G>A (p.Trp573Ter) | GGAGTGGTRGGCCTGGAAACAGG | Pseudoprimary hyperaldosteronism |
| 104894630 | SCO1 | NM_004589.3(SCO1): c.521C>T (p.Pro174Leu) | CCCTGATGTCTGTCYAGAAGAAC | Cytochrome-c oxidase deficiency |
| 587777220 | SCO1 | NM_004589.3(SCO1): c.394G>A (p.Gly132Ser) | CCCCCAAGTAAAGGCTTGCYGAT, CCCCAAGTAAAGGCTTGCYGATG, CCCAAGTAAAGGCTTGCYGATGT, CCAAGTAAAGGCTTGCYGATGTG | Cytochrome-c oxidase deficiency |
| 397515337 | SDCCAG8 | NM_006642.3(SDCCAG8): c.740+356C>T | CCAACATGGTGAAACCCYGTTTC | Bardet-Biedl syndrome 16 |
| 137852768 | SDHA | NM_004168.3(SDHA): c.1664G>A (p.Gly555Glu) | CCCAGRAATGGTCTGGAACACGG | Mitochondrial complex II deficiency, Dilated cardiomyopathy 1GG |
| 9809219 | SDHA | NM_004168.3(SDHA): c.1660C>T (p.Arg554Trp) | CCTGAAGACGTTCGACYGGGGTG | Mitochondrial complex II deficiency |
| 74315371 | SDHB | NM_003000.2(SDHB): c.302G>A (p.Cys101Tyr) | TCTTRTGCAATGAACATCAATGG | Pheochromocytoma |
| 786203251 | SDHB | NM_003000.2(SDHB): c.724C>T (p.Arg242Cys) | CCCATTCTCTCTATACYGCTGCC, CCATTCTCTCTATACYGCTGCCA | Hereditary cancer-predisposing syndrome |
| 772551056 | SDHB | NM_003000.2(SDHB): c.137G>A (p.Arg46Gln) | CCTTGTCTGGGTCCCATYGATAG | Hereditary cancer-predisposing syndrome, not provided |
| 587776652 | SDHC | NM_003001.3(SDHC): c.3G>A (p.Met1Ile) | AGATRGCTGCGCTGTTGCTGAGG | Paragangliomas 3 |
| 764575966 | SDHC | NM_003001.3(SDHC): c.397C>T (p.Arg133Ter) | CCTGGAATGGGATCYGACACTTG | Hereditary cancer-predisposing syndrome |
| 34677591 | SDHD | NM_003002.3(SDHD): c.34G>A (p.Gly12Ser) | TGCRGTGCCCTAGGAGGCCGAGG | Pheochromocytoma, Paragangliomas 1, Hereditary cancer-predisposing syndrome, Carcinoid tumor of intestine, Cowden syndrome 3, not specified, not provided |
| 104894306 | SDHD | NM_003002.3(SDHD): c.64C>T (p.Arg22Ter) | CCTCAGCTCTGTTGCTTYGAACT | Pheochromocytoma, Paragangliomas 1 |
| 80338844 | SDHD | NM_003002.3(SDHD): c.242C>T (p.Pro81Leu) | CCTGGGTCTGCTTCYGGCTGCTT Pheochromocytoma | Pheochromocytoma, Hereditary Paraganglioma-Syndromes, Paragangliomas 1, Hereditary cancer-predisposing syndrome |
| 121918222 | SEC23B | NM_032985.4(SEC23B): c.40C>T (p.Arg14Trp) | CCAGCAGAATGAAGAAYGGGATG | Congenital dyserythropoietic anemia, type II, not provided |
| 121918226 | SEC23B | NM_032985.4(SEC23B): c.649C>T (p.Arg217Ter) | CCCATGCAGCAAGCAYGACCTGC, CCATGCAGCAAGCAYGACCTGCA | Congenital dyserythropoietic anemia, type II, not provided |
| 727504145 | SEC23B | NM_032985.4(SEC23B): c.1489C>T (p.Arg497Cys) | CCCAGAGACGCATCYGCGTGACC | not provided |
| 786204845 | SEC24D | NM_014822.2(SEC24D): c.613C>T (p.Gln205Ter) | CCTCCTCCTCCAAATGCCYAGTA, CCTCCTCCAAATGCCYAGTACCA | COLE-CARPENTER SYNDROME 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 730880269 | SECISBP2 | NM_024077.4(SECISBP2): c.1212+29G>A | CATGGTRTGATATAATAAGTGGG, ACATGGTRTGATATAATAAGTGG | Thyroid hormone metabolism, abnormal |
| 121918341 | SEMA3E | NM_012431.2(SEMA3E): c.2108C>T (p.Ser703Leu) | CCTGCTCAGAGTAGCATCTYGCA | CHARGE association |
| 41265017 | SEMA4A | NM_001193301.1(SEMA4A): c.2138G>A (p.Arg713Gln) | CGGGCTCRGGGCAAGGTTCAGGG, CCGGGCTCRGGGCAAGGTTCAGG | Retinitis pigmentosa 35, not specified |
| 587776597 | SEPN1 | NM_020451.2(SEPN1): 85G>A (p.5ec462=) | GCTRAGGTGAGGGCCCGGCTGG, TCCTGCTRAGGTGAGGGCCCGG | Eichsfeld type congenital muscular dystrophy |
| 55819880 | SERPINA1 | NM_001127701.1 (SERPINA1):c.230C>T (p.Ser77Phe) | CCAATATCTTCTTCTYCCCAGTG | Alpha-1-antitrypsin deficiency |
| 28929488 | SERPINA6 | NM_001756.3(SERPINA6): c.1165G>A (p.Asp389Asn) | TGATCTTCRACCACTTCACCTGG | Corticosteroid-binding globulin deficiency |
| 72554659 | SERPINA7 | NM_000354.5(SERPINA7): c.1051C>T (p.His351Tyr) | CCCCACACAGGCTGCCYATAAGG, CCCACACAGGCTGCCYATAAGGC, CCACACAGGCTGCCYATAAGGCT | |
| 121909546 | SERPINC1 | NM_000488.3(SERPINC1): c.1306G>A (p.Ala436Thr) | CAAGRCCAACAGGCCTTTCCTGG | Antithrombin III deficiency |
| 121909562 | SERPINC1 | NM_000488.3(SERPINC1): c.481C>T (p.Arg161Ter) | CCAAACTGAACTGCYGACTCTAT | Antithrombin III deficiency |
| 121909567 | SERPINC1 | NM_000488.3(SERPINC1): c.391C>T (p.Leu131Phe) | CCTGTAATGACACCYTCCAGCAA | Antithrombin III deficiency |
| 28929469 | SERPINC1 | NM_000488.3(SERPINC1): c.166C>T (p.Arg56Cys) | CCCATGTGCATTTACYGCTCCCC, CCATGTGCATTTACYGCTCCCCG | Antithrombin III deficiency |
| 6092 | SERPINE1 | NM_000602.4(SERPINE1): c.43G>A (p.Ala15Thr) | CTGRCCCTTGTCTTTGGTGAAGG | Plasminogen activator inhibitor type 1 deficiency |
| 193302873 | SERPINF1 | NM_002615.5(SERPINF1): c.1132C>T (p.Gln378Ter) | CCCCCAGCCCAGGGCTGYAGCCT, CCCCAGCCCAGGGCTGYAGCCTG, CCCAGCCCAGGGCTGYAGCCTGC, CCAGCCCAGGGCTGYAGCCTGCC | Osteogenesis imperfecta type 12, not provided |
| 121907950 | SERPING1 | NM_000062.2(SERPING1): c.1394C>T (p.Ala465Val) | CCTCCGCCATCTCTGTGGYCCGC, CCGCCATCTCTGTGGYCCGCACC | Complement component 4, partial deficiency of, due to dysfunctional c1 inhibitor |
| 28940290 | SETX | NM_015046.5(SETX): c.6638C>T (p.Pro2213Leu) | CCTAAGCAGCTCCCTCYGACAGT | Spinocerebellar ataxia autosomal recessive 1 |
| 267607044 | SETX | NM_015046.5(SETX): c.3880C>T (p.Arg1294Cys) | CCTGAAAAGGGTCCTYGTAAGG | Spinocerebellar ataxia autosomal recessive 1 |
| 121917836 | SFTPC | NM_003018.3(SFTPC): c.196G>A (p.Glu66Lys) | ACGRAGATGGTGAGAGGTGTGGG, CACGRAGATGGTGAGAGGTGTGG | Surfactant metabolism dysfunction, pulmonary, 2 |
| 143570936 | SGCA | NM_000023.2(SGCA): c.739G>A (p.Val247Met) | CAATRTGACCCTGGTGAGGAGGG, GCAATRTGACCCTGGTGAGGAGG, GGTGCAATRTGACCCTGGTGAGG | Limb-girdle muscular dystrophy, type 2D, not provided |
| 28933693 | SGCA | NM_000023.2(SGCA): c.229C>T (p.Arg77Cys) | CCTGCCCCGGTGGCTCYGCTACA | Limb-girdle muscular dystrophy, type 2D, not provided |
| 387907298 | SGCA | NM_000023.2(SGCA): c.574C>T (p.Arg192Ter) | CCCCCTTCCCATTGAGGGCYGAA, CCCCTTCCCATTGAGGGCYGAAA, CCCTTCCCATTGAGGGCYGAAAG | Limb-girdle muscular dystrophy, type 2D |
| 104894635 | SGSH | NM_000199.3(SGSH): c.734G>A (p.Arg245His) | TCGGCCRCATGGACCAAGGTGGG, GTCGGCCRCATGGACCAAGGTGG | Mucopolysaccharidosis, MPS-III-A, not provided |
| 104894639 | SGSH | NM_000199.3(SGSH): c.1339G>A (p.Glu447Lys) | CCCCACRAGACCCAGAACCTGG | Mucopolysaccharidosis, MPS-III-A, not provided |
| 111033627 | SH2D1A | NM_002351.4(SH2D1A): c.203C>T (p.Thr68Ile) | CCTTTTATTTTCCAGAYAGCACC | Lymphoproliferative syndrome 1, X-linked |
| 367543284 | SH3PXD2B | NM_001017995.2 (SH3PXD2B):c.401+1G>A | CAAAGARTAAGTTTGTTTGTGGG, CCAAAGARTAAGTTTGTTTGTGG | Frank Ter Haar syndrome, Borrone Di Rocco Crovato syndrome |
| 267607046 | SH3PXD2B | NM_001017995.2 (SH3PXD2B):c.127C>T (p.Arg43Trp) | CCACCGAGGCCATTTACYGGCGC, CCGAGGCCATTTACYGGCGCTAC | Frank Ter Haar syndrome |
| 80338922 | SH3TC2 | NM_024577.3(SH3TC2): c.1178-1G>A | CTTACARCATCCCAGCCTGAAGG | Charcot-Marie-Tooth disease, type 4C |
| 80338923 | SH3TC2 | NM_024577.3(SH3TC2): c.1586G>A (p.Arg529His) | GCCCRTCTCTGCTTCCTCCTGGG, TGCCCRTCTCTGCTTCCTCCTGG | Charcot-Marie-Tooth disease, type 4C |
| 80338926 | SH3TC2 | NM_024577.3(SH3TC2): c.1972C>T (p.Arg658Cys) | CCTGCCCTTTGCCGAGYGCCTGC | Charcot-Marie-Tooth disease, type 4C |
| 80338937 | SH3TC2 | NM_024577.3(SH3TC2): c.3601C>T (p.Gln1201Ter) | CCTCTGTCCACCATGGCTGYAGA | Charcot-Marie-Tooth disease, type 4C |
| 387906932 | SHANK3 | NM_033517.1(SHANK3): c.3349C>T (p.Arg1117Ter) | CCCTGGCTGCCCGAGAGYGAGCT, CCTGGCTGCCCGAGAGYGAGCTC | Schizophrenia 15 |
| 104894043 | SHH | NM_000193.3(SHH): c.676G>A (p.Ala226Thr) | GTGCTGRCGGCGGACGACCAGGG, CGTGCTGRCGGCGGACGACCAGG | Holoprosencephaly 3 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894047 | SHH | NM_000193.3(SHH): c.869G>A (p.Gly290Asp) | CGGRCTCGGGGCCGCCTTCCGGG, TCGGRCTCGGGGCCGCCTTCCGG | Holoprosencephaly 3, Schizencephaly, not specified |
| 587778805 | SHH | NM_000193.3(SHH): c.664G>A (p.Asp222Asn) | CGGGRACCGCGTGCTGGCGGCGG, CCCCGGGRACCGCGTGCTGGCGG | Holoprosencephaly 3 |
| 137853341 | SHH | NM_000193.3(SHH): c.1147G>A (p.Ala383Thr) | CCGCCTGRCGCACGCGCTCCTGG | Holoprosencephaly 3 |
| 587778803 | SHH | NM_000193.3(SHH): c.625C>T (p.Gln209Ter) | CCACGGTGCACCTGGAGYAGGGC | Holoprosencephaly 3 |
| 137852556 | SHOX | NM_000451.3(SHOX): c.517C>T (p.Arg173Cys) | CCGGAGAGCCAAGTGCYGCAAAC | Leri Weill dyschondrosteosis |
| 121912616 | SI | NM_001041.3(SI): c.3218G>A (p.Gly1073Asp) | CTTTTGRCATCCAGATTCGACGG | Sucrase-isomaltase deficiency |
| 786205162 | SIK1 | NM_173354.3(SIK1): c.1897C>T (p.Gln633Ter) | CCCCTTCCACGCCCCTGCAYAGA, CCCTTCCACGCCCCTGCAYAGAG, CCTTCCACGCCCCTGCAYAGAGC | EPILEPTIC ENCEPHALOPATHY, EARLY INFANTILE, 30 |
| 119456965 | SIL1 | NM_001037633.1(SIL1): c.331C>T (p.Arg111Ter) | CCAATATGAGGACAAGTTCYGAA | Marinesco-Sj\xc3V(b6gren syndrome |
| 119456966 | SIL1 | NM_001037633.1(SIL1): c.1312C>T (p.Gln438Ter) | CCAGCCTGGAGCTGYAGGATGGT | Marinesco-Sj\xc3V(b6gren syndrome, not provided |
| 80356459 | SIX1 | NM_005982.3(SIX1): c.328C>T (p.Arg110Trp) | CCGTGGGCAAATATYGGGTGCGC | Branchiootic syndrome 3 |
| 121917881 | SIX3 | NM_005413.3(SIX3): c.206G>A (p.Gly69Asp) | CGGCGRCTCCAGGGCCCCCCCGG | Holoprosencephaly 2 |
| 80356462 | SIX5 | NM_175875.4(SIX5): c.886G>A (p.Ala296Thr) | TCCRCCGAGGCCGCTGCCCAGGG, GTCCRCCGAGGCCGCTGCCCAGG | Branchiootorenal syndrome 2 |
| 121918366 | SLC11A2 | NM_001174125.1(SLC11A2): c.1333C>T (p.Arg445Cys) | CCCGAGTGGTTCTGACTYGCTCT, CCGAGTGGTTCTGACTYGCTCTA | Hypochromic microcytic anemia with iron overload |
| 267607051 | SLC12A3 | NM_000339.2(SLC12A3): c.2612G>A (p.Arg871His) | AAGATCCRTGTGTTCGTAGGCGG | Familial hypokalemia-hypomagnesemia |
| 28936388 | SLC12A3 | NM_000339.2(SLC12A3): c.625C>T (p.Arg209Trp) | CCTACTTCCTCATCTCCYGGAGT | Familial hypokalemia-hypomagnesemia |
| 371443644 | SLC12A3 | NM_000339.2(SLC12A3): c.179C>T (p.Thr60Met) | CCTTTGGCTACAACAYGATCGAT | Familial hypokalemia-hypomagnesemia |
| 606231229 | SLC12A6 | NM_005135.2(SLC12A6): c.3247C>T (p.Arg1083Ter) | CCGAGGGACTAGAGYGAGTCCTA | Andermann syndrome |
| 121908428 | SLC12A6 | NM_133647.1(SLC12A6): c.2023C>T (p.Arg675Ter) | CCCAACTGGAGACCCYGATTCCG, CCAACTGGAGACCCYGATTCCGC | Andermann syndrome |
| 587777577 | SLC13A5 | NM_177550.4(SLC13A5): c.680C>T (p.Thr227Met) | TCCCRTCCCGGTCAGGGTGCGG, GGGTCCCRTCCCGGTCAGGGTGG | Epileptic encephalopathy, early infantile, 25 |
| 121909386 | SLC16A12 | NM_213606.3(SLC16A12): c.733C>T (p.Gln245Ter) | CCATGTGTGTAGAACTYAGAAAG | Cataract, juvenile, with microcornea and glucosuria |
| 587784382 | SLC16A2 | NM_006517.4(SLC16A2): c.916C>T (p.Gln306Ter) | CCAGCGCTTTCTGGCTYAGCTCA | Allan-Herndon-Dudley syndrome |
| 587784386 | SLC16A2 | NM_006517.4(SLC16A2): c.277C>T (p.Gln93Ter) | CCGCGCGCGGCTTCYAGCCTCCC | Allan-Herndon-Dudley syndrome |
| 80338794 | SLC17A5 | NM_012434.4(SLC17A5): c.115C>T (p.Arg39Cys) | CCAGTGTGCTGCTCTGCTYGTTA | Salla disease |
| 606231251 | SLC17A9 | NM_022082.3(SLC17A9): c.932G>A (p.Arg311Gln) | GTGCRAAGCTCATGCAGGTAGG, CACGGTGCRAAGCTCATGCAGG | Porokeratosis 8, disseminated superficial actinic type |
| 548728088 | SLC17A9 | NM_022082.3(SLC17A9): c.25C>T (p.Arg9Cys) | CCACCCCAGACGAGGCCYGCAG, CCCCAGACGAGGCCYGCAGGGA, CCCCAGACGAGGCCYGCAGGGAC | Porokeratosis 8, disseminated superficial actinic type |
| 121908540 | SLC19A2 | NM_006996.2(SLC19A2): c.152C>T (p.Pro51Leu) | CCTCAGGCCGTCCGAGCYCTTCC | Megaloblastic anemia, thiamine-responsive, with diabetes mellitus and sensorineural deafness |
| 587777696 | SLC1A1 | NM_004170.5(SLC1A1): c.1333C>T (p.Arg445Trp) | CCCGTCTCTCCCCAGGGACYGGT, CCGTCTCTCCCCAGGGACYGGTT | Dicarboxylic aminoaciduria |
| 121907892 | SLC22A12 | NM_144585.3(SLC22A12): c.774G>A (p.Trp258Ter) | CTGRACACTGCTGCAGCTGGTGG, GGACTGRACACTGCTGCAGCTGG | Familial renal hypouricemia |
| 121907896 | SLC22A12 | NM_144585.3(SLC22A12): c.269G>A (p.Arg90His) | GCCRCTTCCGCCAGCCACAGTGG | Familial renal hypouricemia |
| 78838117 | SLC22A18 | NM_002555.5 (SLC22A18): c.257G>A (p.Arg86His) | AGACCAGCRCGGGGCGCGGGCGG | |
| 121909071 | SLC22A18 | NM_183233.2(SLC22A18): c.698C>T (p.Ser233Phe) | CCTGAAGGCCATCGCCTYCCTGC | Lung cancer |
| 121908891 | SLC22A5 | NM_003060.3(SLC22A5): c.1196G>A (p.Arg399Gln) | TTTGCCCCRGCGCTATTCCATGG | Renal carnitine transport defect |
| 386134210 | SLC22A5 | NM_003060.3(SLC22A5): c.845G>A (p.Arg282Gln) | CCCCCRATGGCTCATCTCTCAGGG, CCCCCRATGGCTCATCTCTCAGG | Renal carnitine transport defect |
| 386134199 | SLC22A5 | NM_003060.3(SLC22A5): c.641C>T (p.Ala214Val) | CCAACTATGTGGCAGYATTTGTC | Renal carnitine transport defect, not provided |
| 368647424 | SLC25A1 | NM_005984.4(SLC25A1): c.389G>A (p.Gly130Asp) | CCTCGGCCACGCCAGCGYCCAGG | Combined d-2- and l-2-hydroxyglutaric aciduria |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908532 | SLC25A13 | NM_014251.2(SLC25A13): c.1763G>A (p.Arg588Gln) | TTTCRATCCTCACCCCAGTTTGG | Citrullinemia type II |
| 80338715 | SLC25A13 | NM_014251.2(SLC25A13): c.15G>A (p.Lys5=) | CCAARGTAACCGCGGGCCCGAGG | Neonatal intrahepatic cholestasis caused by citrin deficiency |
| 202247804 | SLC25A15 | NM_014252.3(SLC25A15): c.569G>A (p.Gly190Asp) | TCGGTGRCTATGAACTGAGCCGG | Hyperornithinemia-hyperammonemia-homocitrullinuria syndrome |
| 202247805 | SLC25A15 | NM_014252.3(SLC25A15): c.658G>A (p.Gly220Arg) | GAGTTGGTRGGATTTGCCTCTGG | Hyperornithinemia-hyperammonemia-homocitrullinuria syndrome |
| 104894431 | SLC25A15 | NM_014252.3(SLC25A15): c.824G>A (p.Arg275Gln) | ATTCRAGCATTCCCTGCCAATGG | Hyperornithinemia-hyperammonemia-homocitrullinuria syndrome |
| 202247809 | SLC25A15 | NM_014252.3(SLC25A15): c.847C>T (p.Leu283Phe) | CCCTGCCAATGGAGCAYTCTTTT, CCTGCCAATGGAGCAYTCTTTTT | Hyperornithinemia-hyperammonemia-homocitrullinuria syndrome |
| 151340616 | SLC25A20 | NM_000387.5(SLC25A20): c.496C>T (p.Arg166Ter) | CCAGGAGTTTGGGATCYGAGGCA | Carnitine acylcarnitine translocase deficiency |
| 104894375 | SLC25A3 | NM_005888.3(SLC25A3): c.215G>A (p.Gly72Glu) | CTTGGAGRAATTATTAGCTGTGG | Mitochondrial phosphate carrier deficiency |
| 398122942 | SLC25A4 | NM_001151.3(SLC25A4): c.111+1G>A | TGCTGCAGRTGAGGACCGCGCGG | Mitochondrial DNA depletion syndrome 12 (cardiomyopathic type) |
| 111033309 | SLC26A4 | NM_000441.1(SLC26A4): c.2015G>A (p.Gly672Glu) | TGTTGRAGTGAGATCACTGCGGG, TTGTTGRAGTGAGATCACTGCGG | Pendred syndrome, Enlarged vestibular aqueduct syndrome |
| 111033220 | SLC26A4 | NM_000441.1(SLC26A4): c.1229C>T (p.Thr410Met) | CCACTGCTCTTTCCCGCAYGGCC | Pendred syndrome, Enlarged vestibular aqueduct syndrome |
| 142724470 | SLC26A8 | NM_052961.3(SLC26A8): c.2434G>A (p.Glu812Lys) | CCCGTATCACTGTCTYGGATTCA, CCGTATCACTGTCTYGGATTCAT | Spermatogenic failure 3 |
| 137853132 | SLC27A4 | NM_005094.3(SLC27A4): c.274G>A (p.Ala92Thr) | AAGACGRCCCTGATCTTCGAGGG, CAAGACGRCCCTGATCTTCGAGG | Ichthyosis prematurity syndrome |
| 121912583 | SLC29A3 | NM_018344.5(SLC29A3): c.1279G>A (p.Gly427Ser) | CAACRGCTACCTCAGCACCCTGG | Histiocytosis-lymphadenopathy plus syndrome |
| 387907066 | SLC29A3 | NM_018344.5(SLC29A3): c.1088G>A (p.Arg363Gln) | GTGGCCRGCAGCTCACCGCCTGG | Histiocytosis-lymphadenopathy plus syndrome |
| 587780462 | SLC29A3 | NM_018344.5(SLC29A3): c.1228C>T (p.Gln410Ter) | CCTGAAGACTGTGGTCTTCYAGT | Histiocytosis-lymphadenopathy plus syndrome |
| 80359814 | SLC2A1 | NM_006516.2(SLC2A1): c.272G>A (p.Gly91Asp) | CTTTGRCCGGTAAGTAGGAGAGG | Glucose transporter type 1 deficiency syndrome |
| 80359841 | SLC2A1 | NM_006516.2(SLC2A1): c.18+1G>A | AAGRTGAGTCGCGCGCCCGCGG, CAAGRTGAGTCGCGCGCCCGCGG | not provided |
| 121909739 | SLC2A1 | NM_006516.2(SLC2A1): c.940G>A (p.Gly314Ser) | TGGCTCCRGTATCGTCAACACGG | GLUT1 deficiency syndrome 2, Glucose transporter type 1 deficiency syndrome, Epilepsy, idiopathic generalized, susceptibility to, 12, not provided |
| 796053248 | SLC2A1 | NM_006516.2(SLC2A1): c.667C>T (p.Arg223Trp) | CCGCAACGAGGAGAACYGGGCCA | not provided |
| 796053253 | SLC2A1 | NM_006516.2(SLC2A1): c.971C>T (p.Ser324Leu) | CCTTCACTGTCGTGTYGGTGAGT | not provided |
| 387907313 | SLC2A1 | NM_006516.2(SLC2A1): c.694C>T (p.Arg232Cys) | CCCAGTGCTAAAGAAGCTGYGCG, CCAGTGCTAAAGAAGCTGYGCGG | Epilepsy, idiopathic generalized, susceptibility to, 12, not provided |
| 121909743 | SLC2A2 | NM_000340.1(SLC2A2): c.901C>T (p.Arg301Ter) | CCAATTCCAGCTACYGACAGCCT | Fanconi-Bickel syndrome |
| 281860290 | SLC30A10 | NM_018713.2(SLC30A10): c.922C>T (p.Gln308Ter) | CCGCTGCCATTCTGCTAYAGATG | Hypermanganesemia with dystonia, polycythemia and cirrhosis |
| 121918237 | SLC34A3 | NM_001177317.1(SLC34A3): c.586G>A (p.Gly196Arg) | CGGTGCACRGGATCTTCAACTGG | Autosomal recessive hypophosphatemic bone disease |
| 587777436 | SLC35A2 | NM_001042498.2(SLC35A2): c.638C>T (p.Ser213Phe) | GAAGCCGRAGGAGAGACAGGAGG | CONGENITAL DISORDER OF GLYCOSYLATION, TYPE IIm |
| 587776962 | SLC35A2 | NM_001042498.2(SLC35A2): c.3G>A (p.MetIIle) | CCAGCCCCAACCGCTGCYATGTT | CONGENITAL DISORDER OF GLYCOSYLATION, TYPE IIm |
| 28939087 | SLC35C1 | NM_018389.4(SLC35C1): c.439C>T (p.Arg147Cys) | CCTTCTACAATGTGGGCYGCTCA | Congenital disorder of glycosylation type 2C |
| 137853111 | SLC35D1 | NM_015139.2(SLC35D1): c.932G>A (p.Trp311Ter) | TTCACGTRGACAAACTTCATTGG | Schneckenbecken dysplasia |
| 80356492 | SLC37A4 | NM_001164277.1(SLC37A4): c.1099G>A (p.Ala367Thr) | CCACRCCATTGTGGGACTCATGG | Glucose-6-phosphate transport defect, not provided |
| 121908980 | SLC37A4 | NM_001164277.1(SLC37A4): c.1016G>A (p.Gly339Asp) | GTATTTGRTTTCTCCTCGTATGG | Glucose-6-phosphate transport defect, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908979 | SLC37A4 | NM_001164277.1(SLC37A4): c.1243C>T (p.Arg415Ter) | CCTTCTTCCTCCTAYGAAACATC | Glucose-6-phosphate transport defect |
| 587777256 | SLC38A8 | NM_001080442.2(SLC38A8): c.1234G>A (p.Gly412Arg) | CCAGCACAGAGACCACTCYCCAG | |
| 121434363 | SLC39A13 | NM_001128225.2 (SLC39A13):c.221G>A (p.Gly74Asp) | TCCTGGRTTCCCTCATGGTGGGG, CTCCTGGRTTCCCTCATGGTGGG, CCTCCTGGRTTCCCTCATGGTGG | Spondylocheirodysplasia, Ehlers-Danlos syndrome-like |
| 121434288 | SLC39A4 | NM_130849.3(SLC39A4): c.1576G>A (p.Gly526Arg) | GACCRGGCTGGCCACCTCGCTGG | Hereditary acrodermatitis enteropathica |
| 121434292 | SLC39A4 | NM_130849.3(SLC39A4): c.283C>T (p.Arg95Cys) | CCAGGTACGTCGCCYGCCTCAGT | Hereditary acrodermatitis enteropathica |
| 121912621 | SLC45A2 | NM_016180.4(SLC45A2): c.469G>A (p.Asp157Asn) | TTGCTGCCRACTTCATTGATGGG | Oculocutaneous albinism type 4 |
| 730880270 | SLC45A2 | NM_016180.4(SLC45A2): c.563-1G>A | CCARGTTTTGGAGGTGCCCTGGG, TCCARGTTTTGGAGGTGCCCTGG | Oculocutaneous albinism type 4 |
| 794727511 | SLC45A2 | NM_016180.4(SLC45A2): c.856C>T (p.Gln286Ter) | CCAGAGCTGGCAATGYAGGGAGC | Oculocutaneous albinism type 4 |
| 121912741 | SLC4A1 | NM_000342.3(SLC4A1): c.2312G>A (p.Gly771Asp) | CACAGRCCTGTCCATCCTCATGG | Spherocytosis type 4 |
| 121912755 | SLC4A1 | NM_000342.3(SLC4A1): c.2279G>A (p.Arg760Gln) | GCAGCRGATCAGTGGACTCCTGG | Spherocytosis type 4 |
| 28929480 | SLC4A1 | NM_000342.3(SLC4A1): c.268G>A (p.Glu90Lys) | CTGGGGRAGAATGGGGCCTGGGG, CCTGGGGRAGAATGGGGCCTGGG, ACCTGGGGRAGAATGGGGCCTGG | Spherocytosis type 4 |
| 28931584 | SLC4A1 | NM_000342.3(SLC4A1): c.1462G>A (p.Val488Met) | ATCRTGGGCCGCGTGTGGATCGG, AGTACATCRTGGGCCGCGTGTGG | Renal tubular acidosis, distal, with hemolytic anemia, Spherocytosis type 4 |
| 387906565 | SLC4A1 | NM_000342.3(SLC4A1): c.-62G>A | CCCRCGGTGCGGGTTATGCTGGG, ACCCRCGGTGCGGGTTATGCTGG | Spherocytosis type 4 |
| 121912742 | SLC4A1 | NM_000342.3(SLC4A1): c.988C>T (p.Gln330Ter) | CCGATGCCCCCTCCGAGYAGGCA | Spherocytosis type 4 |
| 121912758 | SLC4A1 | NM_000342.3(SLC4A1): c.1936C>T (p.Arg646Trp) | CCAACTCCTCAGCCYGGGGCTGG | |
| 121912759 | SLC4A1 | NM_000342.3(SLC4A1): c.2603C>T (p.Pro868Leu) | CCTCATCCTCACTGTGCYGCTGC | |
| 28931585 | SLC4A1 | NM_000342.3(SLC4A1): c.2608C>T (p.Arg870Trp) | CCTCACTGTGCCGCTGYGGCGCG | Spherocytosis type 4 |
| 121909387 | SLC4A11 | NM_001174089.1(SLC4A11): c.2216G>A (p.Arg739Gln) | GAGACGCRGCTGACCTCGCTGGG, GGAGACGCRGCTGACCTCGCTGG | Corneal endothelial dystrophy type 2 |
| 121909392 | SLC4A11 | NM_001174089.1(SLC4A11): c.2558G>A (p.Arg853His) | CCCATCCRGTACAGGCGGGTGGG, CCCCATCCRGTACAGGCGGGTGG | Corneal endothelial dystrophy type 2 |
| 267607064 | SLC4A11 | NM_001174089.1(SLC4A11): c.2078G>A (p.Gly693Glu) | ACACAGRGCTGTCTCTGTTTGGG, AACACAGRGCTGTCTCTGTTTGG | Corneal dystrophy, Fuchs endothelial, 4 |
| 267607065 | SLC4A11 | NM_001174089.1(SLC4A11): c.1147G>A (p.Glu383Lys) | CAATGACRAGAACACAGACGGGG, TCAATGACRAGAACACAGACGGG | Corneal dystrophy, Fuchs endothelial, 4 |
| 121909390 | SLC4A11 | NM_001174089.1(SLC4A11): c.1765C>T (p.Arg589Ter) | CCTGCACCCCTGCGTGYGAGAGA | Corneal endothelial dystrophy type 2 |
| 121909391 | SLC4A11 | NM_001174089.1(SLC4A11): c.2557C>T (p.Arg853Cys) | CCATGATCCCCATCYGGTACAGG | Corneal endothelial dystrophy type 2 |
| 121908857 | SLC4A4 | NM_001098484.2(SLC4A4): c.1661G>A (p.Arg554His) | TTCRCCTTTGGATTGGCCTGTGG | Renal tubular acidosis, proximal, with ocular abnormalities and mental retardation |
| 375088539 | SLC52A2 | NM_001253815.1(SLC52A2): c.808C>T (p.Gln270Ter) | CCAGACCCTAAGGCCTATYAGCT | Brown-Vialetto-Van Laere syndrome 2 |
| 267606684 | SLC52A3 | NM_033409.3(SLC52A3): c.394C>T (p.Arg132Trp) | CCTGCCGTTCATGAGCYGGCTGC | Brown-Vialetto-Van laere syndrome |
| 121918621 | SLC5A2 | NM_003041.3(SLC5A2): c.1320G>A (p.Trp440Ter) | CTGRCTTCCCGTGGTGCAGGCGG, GGCCTGRCTTCCCGTGGTGCAGG | Familial renal glucosuria |
| 121434347 | SLC6A19 | NM_001003841.2(SLC6A19): c.718C>T (p.Arg240Ter) | CCTGACCATCTTCCTCATCYGAG, CCATCTTCCTCATCYGAGGCCTG | Neutral 1 amino acid transport defect |
| 17279437 | SLC6A20 | NM_020208.3(SLC6A20): c.596C>T (p.Thr199Met) | GCCRTGAAATACACCACCTGCGG | Hyperglycinuria |
| 431905514 | SLC6A3 | NM_001044.4(SLC6A3): c.1031+1G>A | CTACAGRTGAGCCCCTAGCAGGG, GCTACAGRTGAGCCCCTAGCAGG | Infantile Parkinsonism-dystonia |
| 431905516 | SLC6A3 | NM_001044.4(SLC6A3): c.1561C>T (p.Arg521Trp) | CCCAGCCTGTACTGGYGGCTGTG, CCAGCCTGTACTGGYGGCTGTGC | Infantile Parkinsonism-dystonia |
| 122453113 | SLC6A8 | NM_005629.3(SLC6A8): c.1540C>T (p.Arg514Ter) | CCTGTATGATCGGGTACYGACCT | Creatine deficiency, X-linked |
| 121908482 | SLC7A9 | NM_014270.4(SLC7A9): c.583G>A (p.Gly195Arg) | CATCAGCRGGCTGGTGCTCCTGG | Cystinuria |
| 121908483 | SLC7A9 | NM_014270.4(SLC7A9): c.775G>A (p.Gly259Arg) | CATCRGGATCCCCCTGGTGACGG | Cystinuria |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908486 | SLC7A9 | NM_014270.4(SLC7A9): c.782C>T (p.Pro261Leu) | CCATTATCATCGGGATCCYCCTG | Cystinuria |
| 786204831 | SLC9A1 | NM_003047.4(SLC9A1): c.913G>A (p.Gly305Arg) | GGGCRGGGTGCTTGTGGGCGTGG | LICHTENSTEIN-KNORR SYNDROME |
| 119486097 | SLC9A3R1 | NM_004252.4(SLC9A3R1): c.673G>A (p.Glu225Lys) | GGACRGACCAAGCTGCTGGTGG, CGGGGACRAGACCAAGCTGCTG | Nephrolithiasis/osteoporosis, hypophosphatemic, 2 |
| 796053283 | SLC9A6 | NM_006359.2(SLC9A6): c.1631+1G>A | TCATAARTATCCTTAATTGAGGG, ATCATAARTATCCTTAATTGAGG | not provided |
| 398124224 | SLC9A6 | NM_001042537.1(SLC9A6): c.1072C>T (p.Gln358Ter) | CCAAATTACGGGAGTTCYAGTTG | not provided |
| 387906806 | SLCO2A1 | NM_005630.2(SLCO2A1): c.764G>A (p.Gly255Glu) | TGGATTGRAGCCTGGTGGCTAGG | Primary hypertrophic osteoarthropathy, autosomal recessive 2 |
| 587777071 | SLITRK6 | NM_032229.2(SLITRK6): c.541C>T (p.Arg181Ter) | ACAAATCRGAAGATGTTTGGAGG | Deafness, cochlear, with myopia and intellectual impairment |
| 121908317 | SLURP1 | NM_020427.2(SLURP1): c.286C>T (p.Arg96Ter) | CCTGATCTTCTGCTGCTTCYGAG | Acroerythrokeratoderma |
| 587776602 | SLURP1 | NM_020427.2(SLURP1): c.178+1G>A | CCGTGGGGCCTGGCCTCAYCTGC | Acroerythrokeratoderma |
| 387906852 | SMAD3 | NM_005902.3(SMAD3): c.836G>A (p.Arg279Lys) | TGTCAACARGAATGCAGCAGTGG | Loeys-Dietz syndrome 3 |
| 387906853 | SMAD3 | NM_005902.3(SMAD3): c.715G>A (p.Glu239Lys) | TACRAGCTGAACCAGCGCGTCGG | Loeys-Dietz syndrome 3, not provided |
| 377767342 | SMAD4 | NM_005359.5(SMAD4): c.988G>A (p.Glu330Lys) | TTTRAAATGGATGTTCAGGTAGG, TTACTTTRAAATGGATGTTCAGG | |
| 121912581 | SMAD4 | NM_005359.5(SMAD4): c.1054G>A (p.Gly352Arg) | GATRGATACGTGGACCCTTCTGG | Juvenile polyposis/hereditary hemorrhagic telangiectasia syndrome, not provided |
| 377767345 | SMAD4 | NM_005359.5(SMAD4): c.1055G>A (p.Gly352Glu) | GATGRATACGTGGACCCTTCTGG | Juvenile polyposis/hereditary hemorrhagic telangiectasia syndrome |
| 377767356 | SMAD4 | NM_005359.5(SMAD4): c.1168G>A (p.Glu390Lys) | CAGTTGRAATGTAAAGGTGAAGG | Juvenile polyposis syndrome |
| 377767326 | SMAD4 | NM_005359.5(SMAD4): c.403C>T (p.Arg135Ter) | CCATATCACTACGAAYGAGTTGT | Juvenile polyposis syndrome |
| 387907194 | SMARCA2 | NM_003070.4(SMARCA2): c.3395G>A (p.Gly1132Asp) | TGGCCTGGRCTTAAATCTTCAGG | Nicolaides-Baraitser syndrome |
| 281875188 | SMARCA2 | NM_003070.4(SMARCA2): c.2648C>T (p.Pro883Leu) | CCTCTTGACTGGGACCCYGCTGC | Nicolaides-Baraitser syndrome, not provided |
| 587777460 | SMARCA4 | NM_003072.3(SMARCA4): c.3533G>A (p.Trp1178Ter) | CAGCGACTRGAATCCTCACCAGG | Rhabdoid tumor predisposition syndrome 2 |
| 587777461 | SMARCA4 | NM_001128845.1(SMARCA4): c.4071+1G>A | GCTCAAGRTACATGCTGGAGAGG | Rhabdoid tumor predisposition syndrome 2 |
| 587777462 | SMARCA4 | NM_001128849.1(SMARCA4): c.643C>T (p.Gln215Ter) | CCGATGCCCGGGATGCAGYAGCA | Rhabdoid tumor predisposition syndrome 2 |
| 267607070 | SMARCA4 | NM_001128844.1(SMARCA4): c.3565C>T (p.Arg1189Ter) | CCTGCAAGCGCAGGACYGAGCCC | Rhabdoid tumor predisposition syndrome 2 |
| 387906812 | SMARCB1 | NM_003073.3(SMARCB1): c.1130G>A (p.Arg377His) | GATGAGGCRTCTTGCCAACACGG | Mental retardation, autosomal dominant 15 |
| 121434496 | SMARCB1 | NM_003073.3(SMARCB1): c.544C>T (p.Gln182Ter) | CCATGAGAACGCATCTYAGCCCG | |
| 122454123 | SMC1A | NM_006306.3(SMC1A): c.1487G>A (p.Arg496His) | GAGCAGCCRCCAGCAGCGAAAGG | Congenital muscular hypertrophy-cerebral syndrome |
| 587784409 | SMC1A | NM_006306.3(SMC1A): c.2131C>T (p.Arg711Trp) | CCCATGGACTGCAGATGYGGCTC, CCATGGACTGCAGATGYGGCTCA | Congenital muscular hypertrophy-cerebral syndrome |
| 727503776 | SMC | NM_006306.3(SMC1A): c.121C>T (p.Leu41Phe) | CCCTTAGGTAAGTCAAATYTCAT, CCTTAGGTAAGTCAAATYTCATG | Wiedemann-Steiner syndrome |
| 104893930 | SMN1 | NM_000344.3(SMN1): c.88G>A (p.Asp30Asn) | GAGCGATRATTCTGACATTTGGG, AGAGCGATRATTCTGACATTTGG | Spinal muscular atrophy, type II |
| 120074119 | SMPD1 | NM_000543.4(SMPD1): c.1735G>A (p.Gly579Ser) | CCATAAGRGCCACCCACCCTCGG | Niemann-Pick disease, type A |
| 397515550 | SMS | NM_004595.4(SMS): c.200G>A (p.Gly67Glu) | CCCACATGRATTGGTGTTGCTGG | Snyder Robinson syndrome |
| 104893875 | SNCA | NM_000345.3(SNCA): c.136G>A (p.Glu46Lys) | ACCAAGRAGGGAGTGGTGCATGG | Lewy body dementia |
| 104893936 | SNCB | NM_001001502.1(SNCB): c.208G>A (p.Val70Met) | GAGCTRTGTTCTCTGGGCAGGG, GGAGCTRTGTTCTCTGGGCAGG | Lewy body dementia |
| 527236113 | SNRNP200 | NM_014014.4(SNRNP200): c.2042G>A (p.Arg681His) | TAGCTTCCRTCCAGTGCCTCTGG | Retinitis pigmentosa |
| 267607078 | SOBP | NM_018013.3(SOBP): c.1981C>T (p.Arg661Ter) | CCTGACCGTGGGCCACYGAGCCC | Mental retardation, anterior maxillary protrusion, and strabismus |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121912444 | SOD1 | NM_000454.4(SOD1): c.13G>A (p.Ala5Thr) | AAGRCCGTGTGCGTGCTGAAGGG, GAAGRCCGTGTGCGTGCTGAAGG | Amyotrophic lateral sclerosis type 1 |
| 121912447 | SOD1 | NM_000454.4(SOD1): c.436G>A (p.Ala146Thr) | GTTTGRCTTGTGGTGTAATTGGG, CGTTTGRCTTGTGGTGTAATTGG | Amyotrophic lateral sclerosis type 1 |
| 121912450 | SOD1 | NM_000454.4(SOD1): c.64G>A (p.Glu22Lys) | TTCRAGCAGAAGGCAAGGGCTGG, CAATTTCRAGCAGAAGGCAAGGG, TCAATTTCRAGCAGAAGGCAAGG | Amyotrophic lateral sclerosis type 1 |
| 397517147 | SOS1 | NM_005633.3(SOS1): c.1297G>A (p.Glu433Lys) | GGTTGGRAGGGAAAAGACATTGG | Noonan syndrome 4, Rasopathy, not provided |
| 397517159 | SOS1 | NM_005633.3(SOS1): c.2536G>A (p.Glu846Lys) | TTTARAGAAAGAGTAGCTGTGG | Noonan syndrome 4, Rasopathy |
| 727504295 | SOS1 | NM_005633.3(SOS1): c.1322G>A (p.Cys441Tyr) | GTGTTRTAATGAATTTATAATGG | Noonan syndrome 4, Rasopathy |
| 104894644 | SOST | NM_025237.2(SOST): c.372G>A (p.Trp124Ter) | GCAAGTGRTGGCGACCTAGTGGG, GGCAAGTGRTGGCGACCTAGTGG | Sclerosteosis |
| 387907169 | SOST | NM_025237.2(SOST): c.61G>A (p.Val21Met) | GTGTARTGGAGGGCCAGGGGTGG, TCCGTGTARTGGAGGGCCAGGGG | Craniodiaphyseal dysplasia, autosomal dominant |
| 104894645 | SOST | NM_025237.2(SOST): c.376C>T (p.Arg126Ter) | CCGCGGCAAGTGGTGGYGACCTA | Sclerosteosis |
| 387906320 | SOST | NM_025237.2(SOST): c.70C>T (p.Gln24Ter) | CCGTGTAGTGGAGGGCYAGGGGT | Sclerosteosis |
| 121908510 | SPAST | NM_014946.3(SPAST): c.1343G>A (p.Cys448Tyr) | TTTGTRTGAAAGAAGAGAAGGGG, TTTTGTRTGAAAGAAGAGAAGGG, CTTTTGTRTGAAAGAAGAGAAGG | Spastic paraplegia 4, autosomal dominant |
| 149688478 | SPATA5 | NM_145207.2(SPATA5): c.1714+1G>A | CAGRTGAGTGTGGTTTGCTATGG | not provided |
| 796051895 | SPATA5 | NM_145207.2(SPATA5): c.298G>A (p.Ala100Thr) | TATACARCCTGGCCTATGGCAGG | not provided, EPILEPSY, HEARING LOSS, AND MENTAL RETARDATION SYNDROME |
| 200793464 | SPG11 | NM_025137.3(SPG11): c.5974C>T (p.Arg1992Ter) | GTCRACAGTAGTTCTTCCCATGG | Spastic paraplegia 11, autosomal recessive, Amyotrophic lateral sclerosis type 5 |
| 312262785 | SPG11 | NM_025137.3(SPG11): c.6856C>T (p.Arg2286Ter) | CCTCAGGACTCCTGTGTGYGACA | Spastic paraplegia 11, autosomal recessive |
| 267607084 | SPG11 | NM_025137.3(SPG11): c.118C>T (p.Gln40Ter) | CCCCGCCGAGGCGATGGGGYAGC, CCCGCCGAGGCGATGGGGYAGCT, CCGCCGAGGCGATGGGGYAGCTC, CCGAGGCGATGGGGYAGCTCGGC | Spastic paraplegia 11, autosomal recessive, Amyotrophic lateral sclerosis type 5 |
| 606231154 | SPINT2 | NM_021102.3(SPINT2): c.593-1G>A | CCTCARTGGTGGTTCTGGCGGGG, TCCTCARTGGTGGTTCTGGCGGG, GTCCTCARTGGTGGTTCTGGCGG | Diarrhea 3, secretory sodium, congenital, syndromic |
| 104893666 | SPR | NM_003124.4(SPR): c.488C>T (p.Pro163Leu) | CCCTCTGTGCCCTGCAACYTTTC, CCTCTGTGCCCTGCAACYTTTCA | Sepiapterin reductase deficiency |
| 121917746 | SPR | NM_003124.4(SPR): c.355C>T (p.Gln119Ter) | CCTGAGTGACTCCACTYAAGTGA | Sepiapterin reductase deficiency |
| 769987150 | SPTBN2 | NM_006946.2(SPTBN2): c.1915G>T (p.Glu639Ter) | CCAGAGCCGCCGTGATTYCTCCA | Multiple congenital anomalies |
| 267607090 | SPTLC2 | NM_004863.3(SPTLC2): c.1075G>A (p.Val359Met) | CGGGGTRTGGTGGAGTACTTTGG | NEUROPATHY, HEREDITARY SENSORY, TYPE IC |
| 796051870 | SQSTM1 | NM_003900.4(SQSTM1): c.970_1165del | CGCCAGRCAAGTGAACCAAGAGG | Paget disease of bone, familial |
| 776749939 | SQSTM1 | NM_003900.4(SQSTM1): c.1160C>T (p.Pro387Leu) | CCTTGTACCCACATCTCCYGCCA | FRONTOTEMPORAL DEMENTIA AND/OR AMYOTROPHIC LATERAL SCLEROSIS 3 |
| 147810437 | SQSTM1 | NM_001142298.1(SQSTM1): c.98C>T (p.Ala33Val) | CCACCGTGTGCTCAGGAGGYGCC, CCGTGTGCTCAGGAGGYGCCCG | FRONTOTEMPORAL DEMENTIA AND/OR AMYOTROPHIC LATERAL SCLEROSIS 3 |
| 121913314 | SRC | NM_198291.2(SRC): c.1591C>T (p.Gln531Ter) | CCACCGAGCCCAGTACYAGCCC, CCGAGCCCCAGTACYAGCCCGGG | |
| 199469464 | SRCAP | NM_006662.2(SRCAP): c.7330C>T (p.Arg2444Ter) | CCAGCACCTAGGCCYTGACCCAC | Floating-Harbor syndrome |
| 587777656 | SRCAP | NM_006662.2(SRCAP): c.7000C>T (p.Gln2334Ter) | CCGAGAGGAGCTCAAAYAGGCAG | Floating-Harbor syndrome |
| 121434246 | SRD5A2 | NM_000348.3(SRD5A2): c.344G>A (p.Gly115Asp) | AGAGRCACTGCCTTCTGCACTGG | 3-Oxo-5 alpha-steroid delta 4-dehydrogenase deficiency |
| 121434250 | SRD5A2 | NM_000348.3(SRD5A2): c.586G>A (p.Gly196Ser) | TCCTCRGTGAGATCATTGAATGG | 3-Oxo-5 alpha-steroid delta 4-dehydrogenase deficiency |
| 104894965 | SRY | NM_003140.2(SRY): c.209G>A (p.Trp70Ter) | TCGTGTRGTCTCGCGATCAGAGG | 46,XY sex reversal, type 1 |
| 104894966 | SRY | NM_003140.2(SRY): c.337G>A (p.Ala113Thr) | CCAGGAGCACAGAAATTACAGG | 46,XY sex reversal, type 1 |
| 104894967 | SRY | NM_003140.2(SRY): c.320G>A (p.Trp107Ter) | AAAATRGCCATTCTTCCAGGAGG, CGAAAATRGCCATTCTTCCAGG | 46,XY sex reversal, type 1 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894969 | SRY | NM_003140.2(SRY): c.192G>A (p.Met64Ile) | CCATRACGCATTCATCGTGTGG | 46,XY sex reversal, type 1 |
| 104894977 | SRY | NM_003140.2(SRY): c.4C>T (p.Gln2Ter) | CCTTGTTTTTGACAATGYAATCA | 46,XY sex reversal, type 1 |
| 104893668 | ST3GAL5 | NM_003896.3(ST3GAL5): c.862C>T (p.Arg288Ter) | CCTTAGCCATTCTGGGTAYGACT | Amish infantile epilepsy syndrome |
| 534438354 | ST3GAL5 | NM_003896.3(ST3GAL5): c.1063G>A (p.Glu355Lys) | CCCGCCAAACTGACTTYATCGCA, CCGCCAAACTGACTTYATCGCAC | Amish infantile epilepsy syndrome |
| 397509388 | STAMBP | NM_201647.2(STAMBP): c.532C>T (p.Arg178Ter) | CCAGGAGCTAGAAAAAGAGYGAC | Microcephaly-capillary malformation syndrome |
| 397509390 | STAMBP | NM_201647.2(STAMBP): c.1270C>T (p.Arg424Ter) | CCATCACAGACCTTYGATGAGCG | Microcephaly-capillary malformation syndrome |
| 143739249 | STAMBP | NM_201647.2(STAMBP): c.112C>T (p.Arg38Cys) | CCACCCCGTCGGTACTTCYGCTC, CCCCGTCGGTACTTCYGCTCTGG, CCCGTCGGTACTTCYGCTCTGGA | Microcephaly-capillary malformation syndrome |
| 104894085 | STAR | NM_000349.2(STAR): c.772C>T (p.Gln258Ter) | CCCAAGAGCATCATCAACYAGGT, CCAAGAGCATCATCAACYAGGTC | Cholesterol monooxygenase (side-chain cleaving) deficiency |
| 104894090 | STAR | NM_000349.2(STAR): c.562C>T (p.Arg188Cys) | CCGTGACTTTGTGAGCGTGYGCT | Cholesterol monooxygenase (side-chain cleaving) deficiency |
| 387906759 | STAT1 | NM_007315.3(STAT1): c.800C>T (p.Ala267Val) | CCCAGGTTCACTATAGTTGYGGA, CCAGGTTCACTATAGTTGYGGAG | Immunodeficiency 31C |
| 587777647 | STAT3 | NM_003150.3(STAT3): c.2147C>T (p.Thr716Ile) | CAGRTCGTTCTGTAGGAAATGGG, GCAGRTCGTTCTGTAGGAAATGG | Autoimmune disease, multisystem, infantile-onset |
| 113994135 | STAT3 | NM_139276.2(STAT3): c.1144C>T (p.Arg382Trp) | CCCCTGTGATTCAGATCCYGGAA, CCCTGTGATTCAGATCCYGGAAA, CCTGTGATTCAGATCCYGGAAAT | Hyperimmunoglobulin E syndrome |
| 121908502 | STAT5B | NM_012448.3(STAT5B): c.454C>T (p.Arg152Ter) | CCAGACGTTTGAGGAGCTGYGAC | Growth hormone insensitivity with immunodeficiency |
| 397515390 | STIM1 | NM_003156.3(STIM1): c.970-1G>A | CCTARGTTCGGGAGGCCTTGAGG | Immune dysfunction with T-cell inactivation due to calcium entry defect 2 |
| 483352867 | STIM1 | NM_003156.3(STIM1): c.910C>T (p.Arg304Trp) | CCAGCGGCTGAAGGAGCTGYGGG | Stormorken syndrome |
| 730881979 | STK11 | NM_000455.4(STK11): c.526G>A (p.Asp176Asn) | TGCACAAGRACATCAAGCCGGGG | Hereditary cancer-predisposing syndrome |
| 121913323 | STK11 | NM_000455.4(STK11): c.508C>T (p.Gln170Ter) | CCTGGAGTACCTGCATAGCYAGG | Cutaneous malignant melanoma 1 |
| 786201090 | STK11 | NM_000455.4(STK11): c.910C>T (p.Arg304Trp) | CCATCCGGCAGATCYGGCAGCAC | Hereditary cancer-predisposing syndrome |
| 397514639 | STRA6 | NM_001142617.1(STRA6): c.1964G>A (p.Arg655His) | TTCCRCAAGACGGCCCTGTTGGG, CTTCCRCAAGACGGCCCTGTTGG | Microphthalmia syndromic 9 |
| 267607096 | STRA6 | NM_001142617.1(STRA6): c.69G>A (p.Trp23Ter) | CTGRTACATCGATGAGCCCCAGG | Microphthalmia syndromic 9 |
| 118203959 | STRA6 | NM_001142617.1(STRA6): c.1963C>T (p.Arg655Cys) | CCCAACCCTGCAGGTCTTCYGCA, CCAACCCTGCAGGTCTTCYGCAA, CCCTGCAGGTCTTCYGCAAGACG | Microphthalmia syndromic 9 |
| 118203961 | STRA6 | NM_001142617.1(STRA6): c.269C>T (p.Pro90Leu) | CCTTGCCTCTGTGCTAGCCYTGT, CCTGCCTCTGTGCTAGCCYTGTGGATT | Microphthalmia syndromic 9 |
| 377480477 | STRC | NM_153700.2(STRC): c.4402C>T (p.Arg1468Ter) | CCTCRTACATCTGCACAATTTGG | Deafness, autosomal recessive 16 |
| 137853167 | STS | NM_000351.4(STS): c.1022C>T (p.Ser341Leu) | CCCTCATCTACTTCACATYGGAC, CCTCATCTACTTCACATYGGACC | X-linked ichthyosis with steryl-sulfatase deficiency |
| 587777346 | STUB1 | NM_005861.3(STUB1): c.235G>A (p.Ala79Thr) | AGCAGRCCCTGGCCGACTGCCGG | Spinocerebellar ataxia, autosomal recessive 16 |
| 587777310 | STXBP1 | NM_003165.3(STXBP1): c.847G>A (p.Glu283Lys) | TGGACRAGGACGACGACCTGTG | Early infantile epileptic encephalopathy 4 |
| 796053356 | STXBP1 | NM_003165.3(STXBP1): c.569G>A (p.Arg190Gln) | GCTGTGCRGTATCGGGGGTAAGG | not provided |
| 796053360 | STXBP1 | NM_003165.3(STXBP1): c.795-1G>A | CATTCTARGTATGAGACCAGCGG | not provided |
| 796053365 | STXBP1 | NM_003165.3(STXBP1): c.1061G>A (p.Cys354Tyr) | GACTRTATGAAGCATTACCAAGG | not provided |
| 121918318 | STXBP1 | NM_003165.3(STXBP1): c.539G>A (p.Cys180Tyr) | GACCCTTRTGCCACCCTGAAGG | Early infantile epileptic encephalopathy 4 |
| 796053366 | STXBP1 | NM_003165.3(STXBP1): c.1099C>T (p.Arg367Ter) | CCGTAGACAAACTCTGCYGAGTG | not provided |
| 796053376 | STXBP1 | NM_003165.3(STXBP1): c.1672C>T (p.Gln558Ter) | CCTACGAGGTGACCYAGGCCAAC | not provided |
| 28942088 | SUFU | NM_016169.3(SUFU): c.44C>T (p.Pro15Leu) | CGGGRGCGCGGTGGGGCCGGGG, CCGGGRGCGCGGTGGGGCCGGGG, GCGGGRGCGCGGTGGGGCCGGG, GGCCGGGRGCGCGGTGGGGCC | Medulloblastoma |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137852854 | SUMF1 | NM_182760.3(SUMF1): c.653G>A (p.Cys218Tyr) | ACTRCACTTGGGCAGGGAAGCGG | Multiple sulfatase deficiency |
| 137852845 | SUMF1 | NM_182760.3(SUMF1): c.979C>T (p.Arg327Ter) | CCCCCTTCTGGGAAAGACYGAGT, CCCCTTCTGGGAAAGACYGAGTG, CCCTTCTGGGAAAGACYGAGTGA, CCTTCTGGGAAAGACYGAGTGAA | Multiple sulfatase deficiency |
| 121908009 | SUOX | NM_000456.2(SUOX): c.1589G>A (p.Gly530Asp) | GAGRTGTTCTCAGCAATGCCTGG | Sulfite oxidase deficiency, isolated |
| 397514679 | SYN1 | NM_006950.3(SYN1): c.1663C>T (p.Gln555Ter) | CCCGCCTCTCCGTCTCCCYAGCG, CCGCCTCTCCGTCTCCCYAGCGC, CCTCTCCGTCTCCCYAGCGCCAG | Epilepsy, X-linked, with variable learning disabilities and behavior disorders |
| 397514670 | SYNGAP1 | NM_006772.2(SYNGAP1): c.1685C>T (p.Pro562Leu) | CCCCCCAGCGTGTTCCYGAGGGA, CCCCAGCGTGTTCCYGAGGGAG, CCCCAGCGTGTTCCYGAGGGAGC | Mental retardation, autosomal dominant 5 |
| 398122403 | SYNJ1 | NM_203446.2(SYNJ1): c.773G>A (p.Arg258Gln) | GTCCRGGGAACAAATGATGATGG | Parkinson disease 20, early-onset |
| 267607101 | TAB2 | NM_015093.5(TAB2): c.622C>T (p.Pro208Ser) | CCACCTGTACTTAACAGTYCACA, CCTGTACTTAACAGTYCACAGGG | Congenital heart disease, multiple types, 2 |
| 144292455 | TACR3 | NM_001059.2(TACR3): c.824G>A (p.Trp275Ter) | CCTGGGATTCTCCTCCCYAGAG | Hypogonadotropic hypogonadism 11 with or without anosmia |
| 80358223 | TACSTD2 | NM_002353.2(TACSTD2): c.352C>T (p.Gln118Ter) | CCGCTTCAAGGCGCGCYAGTGCA | Lattice corneal dystrophy Type III |
| 80358224 | TACSTD2 | NM_002353.2(TACSTD2): c.619C>T (p.Gln207Ter) | CCAGATCGAGCTGCGGYAGAACA | Lattice corneal dystrophy Type III |
| 397509359 | TAR | NR_104387.1(TAF1): n.5894C>T | CCAAGGCTTTGAGTCTCTTYGTC | Dystonia 3, torsion, X-linked |
| 4884357 | TARDBP | NM_007375.3(TARDBP): c.892G>A (p.Gly298Ser) | GCTRTTTTGGGAAACAATCAAGG | Amyotrophic lateral sclerosis type 10 |
| 387906334 | TARDBP | NM_007375.3(TARDBP): c.*697G>A | ATCCRCTACTCTTTATTTCATGG | Amyotrophic lateral sclerosis type 10, FRONTOTEMPORAL DEMENTIA WITH TDP43 INCLUSIONS, TARDBP-RELATED |
| 794729167 | TAZ | NM_000116.4(TAZ): c.582G>A (p.Trp194Ter) | TCAAGTGRGGTAAGGGCTGCTGG | not provided |
| 794729174 | TAZ | NM_000116.4(TAZ): c.526C>T (p.His176Tyr) | CCATGGGGACTGGGTGYATATCT | not provided |
| 587777157 | TBC1D20 | NM_144628.3(TBC1D20): c.199C>T (p.Arg67Ter) | TTCRTCTGATCTCATCAGTCAGG | Warburg micro syndrome 4 |
| 398122968 | TBC1D24 | NM_001199107.1(TBC1D24): c.1206+5G>A | TGARCAGGGGCCCTGGAGCCAGG | Digitorenocerebral syndrome |
| 483352866 | TBC1D24 | NM_001199107.1(TBC1D24): c.533C>T (p.Ser178Leu) | CCTGGCCTTTGAGTYGTCCTGCA | Deafness, autosomal recessive 86, Deafness, autosomal dominant 65 |
| 748112833 | TBK1 | NM_013254.3(TBK1): c.2086G>A (p.Glu696Lys) | AAAGGAARAGATGGAAGGGGTGG | FRONTOTEMPORAL DEMENTIA AND/OR AMYOTROPHIC LATERAL SCLEROSIS 4 |
| 137852955 | TBX20 | NM_001077653.2(TBX20): c.583C>T (p.Gln195Ter) | CCTTTTACCGGTGAGYAACTACT | Atrial septal defect 4 |
| 104894648 | TBX4 | NM_018488.2(TBX4): c.184C>T (p.Gln62Ter) | CCGCCGCCGCCGCGGAGYAGGTA, CCGCCGCCGCCGCGGAGYAGGGG | Ischiopatellar dysplasia |
| 104894382 | TBX5 | NM_000192.3(TBX5): c.709C>T (p.Arg237Trp) | CCCTTTGCCAAAGGATTTYGGGG, CCTTTGCCAAAGGATTTYGGGGC | Holt-Oram syndrome, Malformation of the heart, not provided |
| 199422117 | TBXAS1 | NM_001061.4(TBXAS1): c.1238G>A (p.Arg413Gln) | ATTCACACRGGAGGCAGCTCAGG | |
| 775636212 | TCAP | NM_003673.3(TCAP): c.208C>T (p.Arg70Trp) | CCCTGGCTGATGATGYGGATGGG, CCTGGCTGATGATGYGGATGGGC | Dilated cardiomyopathy 1N, Hypertrophic cardiomyopathy |
| 777518512 | TCAP | NM_003673.3(TCAP): c.259C>T (p.Arg87Trp) | CCAGCTGCCCTACCAGYGGGTAC | not provided |
| 398123560 | TCF4 | NM_001083962.1(TCF4): c.1086G>A (p.Trp362Ter) | TTGRTCTAGAAATGGAGGACAGG, GCTGTTTGRTCTAGAAATGGAGG | Pitt-Hopkins syndrome |
| 121909120 | TCF4 | NM_001083962.1(TCF4): c.1738C>T (p.Arg580Trp) | CCCGAGAGCGTCTGYGGGTCCGT | Pitt-Hopkins syndrome |
| 727505396 | TCF4 | NM_001083962.1(TCF4): c.1438C>T (p.Gln480Ter) | CCACAGCTTCCTGTCYAGTCTGC | Pitt-Hopkins syndrome |
| 139617644 | TCIRG1 | NM_006019.3(TCIRG1): c.1674-1G>A | CCGCCARGCACTTTGGCCAGAGG | Osteopetrosis autosomal recessive 1 |
| 137853150 | TCIRG1 | NM_006019.3(TCIRG1): c.1213G>A (p.Gly405Arg) | TGTTCRGGGATGTGGGCCACGG, ATGTTCRGGGATGTGGGCCACGG | Osteopetrosis autosomal recessive 1 |
| 119470017 | TCOF1 | NM_000356.3(TCOF1): c.2731C>T (p.Arg911Ter) | CCCCGAGGAAGGCCYGAGCCTCG | Treacher collins syndrome 1 |
| 267607107 | TECTA | NM_005422.2(TECTA): c.5471G>A (p.Gly1824Asp) | CAGCTCGRTTTTGAGAGGGAGGG, CCAGCTCGRTTTTGAGAGGGAGG | Deafness, autosomal dominant 12 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 281865415 | TECTA | NM_005422.2(TECTA): c.5458C>T (p.Leu1820Phe) | CCATATCTAAGTGCAAGYTCTTC | Deafness, autosomal dominant 12 |
| 387906745 | TEK | NM_000459.4(TEK): c.2744G>A (p.Arg915His) | CCTTCRCAAGAGCCGTGTGCTGG | Multiple Cutaneous and Mucosal Venous Malformations |
| 199422287 | TERC | NR_001566.1(TERC): n.450G>A | CATRCAGTTCGCTTTCCTGTTGG | Aplastic anemia |
| 199422280 | TERC | NR_001566.1(TERC): n.322G>A | GTCAGCCRCGGGTCTCTCGGGGG, TGTCAGCCRCGGGTCTCTCGGGG | Aplastic anemia |
| 199422260 | TERC | NR_001566.1(TERC): n.35C>T | CCTGGGAGGGGTGGTGGYCATTT | Dyskeratosis congenita autosomal dominant |
| 199422291 | TERT | NM_198253.2(TERT): c.430G>A (p.Val144Met) | CCGCRTGGGCGACGACGTGCTGG | Idiopathic fibrosing alveolitis, chronic form |
| 149566858 | TERT | NM_198253.2(TERT): c.2177C>T (p.Thr726Met) | CCTCCRTGAGCCTGTCCTGGGGG, ACCTCCRTGAGCCTGTCCTGGGG, GACCTCCRTGAGCCTGTCCTGGG, TGACCTCCRTGAGCCTGTCCTGG | Dyskeratosis congenita, autosomal dominant |
| 121918662 | TERT | NM_198253.2(TERT): c.2080G>A (p.Val694Met) | CACCTTCRTGCTGCGTGTGCGGG, GCACCTTCRTGCTGCGTGTGCGG | Aplastic anemia, PULMONARY FIBROSIS AND/OR BONE MARROW FAILURE, TELOMERE-RELATED, 1 |
| 121918664 | TERT | NM_198253.2(TERT): c.3268G>A (p.Val1090Met) | TCACCTACRTGCCACTCCTGGGG | Aplastic anemia, PULMONARY FIBROSIS AND/OR BONE MARROW FAILURE, TELOMERE-RELATED, 1 |
| 199422294 | TERT | NM_198253.2(TERT): c.1892G>A (p.Arg631Gln) | GCTGCRGCCGATTGTGAACATGG | Idiopathic fibrosing alveolitis, chronic form, Dyskeratosis congenita, autosomal dominant, 2 |
| 199422295 | TERT | NM_198253.2(TERT): c.2045G>A (p.Gly682Asp) | TGGRCCTGGACGATATCCACAGG | Dyskeratosis congenita autosomal dominant |
| 199422309 | TERT | NM_198253.2(TERT): c.219+1G>A | CAGRTGGGCCTCCCCGGGGTCGG, CCGCCAGRTGGGGCCTCCCCGGGG, TCCGCCAGRTGGGCCTCCCCGGG | Idiopathic fibrosing alveolitis, chronic form, PULMONARY FIBROSIS AND/OR BONE MARROW FAILURE, TELOMERE-RELATED, 1 |
| 199422293 | TERT | NM_198253.2(TERT): c.1456C>T (p.Arg486Cys) | CCAGGCACAACGAACGCYGCTTC | Idiopathic fibrosing alveolitis, chronic form |
| 199422297 | TERT | NM_198253.2(TERT): c.2110C>T (p.Pro704Ser) | CCCAGGACCCGCCGYCTGAGCTG | Dyskeratosis congenita autosomal dominant, Dyskeratosis congenita, autosomal recessive, 4 |
| 199422301 | TERT | NM_198253.2(TERT): c.2431C>T (p.Arg811Cys) | CCTCTTCGACGTCTTCCTAYGCT | Dyskeratosis congenita autosomal recessive 1, Dyskeratosis congenita, autosomal recessive, 4 |
| 141425941 | TERT | NM_198253.2(TERT): c.2371G>A (p.Val791Ile) | CCCAGACCTGCTCGATGAYGACG, CCAGACCTGCTCGATGAYGACGG | PULMONARY FIBROSIS AND/OR BONE MARROW FAILURE, TELOMERE-RELATED, 1 |
| 121918676 | TF | NM_001063.3(TF): c.830G>A (p.Gly277Asp) | GCGRCAAGGAGGACTTGATCTGG | |
| 121918681 | TF | NM_001063.3(TF): c.229G>A (p.Asp77Asn) | CGAAGCGRATGCTGTGACACTGG | Atransferrinemia |
| 80338876 | TFR2 | NM_003227.3(TFR2): c.64G>A (p.Val22Ile) | ACCRTCTACCAGCGTGTGGAAGG, TCAGACCRTCTACCAGCGTGTGG | Hemochromatosis type 3 |
| 80338881 | TFR2 | NM_003227.3(TFR2): c.949C>T (p.Gln317Ter) | CCAAGCCTGTCCAGCCAGYAGGC | Hemochromatosis type 3 |
| 80338882 | TFR2 | NM_003227.3(TFR2): c.1186C>T (p.Arg396Ter) | CCTGGGCCCCGGGCCAYGACTGC | Hemochromatosis type 3 |
| 121912650 | TG | NM_003235.4(TG): c.7007G>A (p.Arg2336Gln) | AGCTACCRAGTGGGTGTCTTCGG | Iodotyrosyl coupling defect |
| 121912646 | TG | NM_003235.4(TG): c.4588C>T (p.Arg1530Ter) | CCAGAATGGCCAGTATYGAGCCA | Iodotyrosyl coupling defect |
| 121909209 | TGFBI | NM_000358.2(TGFBI): c.1664G>A (p.Arg555Gln) | AGAGAACRGAGCAGACTCTTGGG, AAGAGAACRGAGCAGACTCTTGG | Thiel-Behnke corneal dystrophy |
| 121909208 | TGFBI | NM_000358.2(TGFBI): c.1663C>T (p.Arg555Trp) | CCCTGCCACCAAGAGAAYGGAGC, CCTGCCACCAAGAGAAYGGAGCA | Groenouw corneal dystrophy type I |
| 121918712 | TGFBR1 | NM_004612.3(TGFBR1): c.599C>T (p.Thr200Ile) | CCATTGCTTGTTCAGAAYAAT | Loeys-Dietz syndrome 1 |
| 111854391 | TGFBR1 | NM_004612.3(TGFBR1): c.722C>T (p.Ser241Leu) | CCTCTAGAAGAACGTTYGTGG | Loeys-Dietz syndrome, Loeys-Dietz syndrome 1 |
| 104893816 | TGFBR2 | NM_003242.5(TGFBR2): c.1379G>A (p.Arg460His) | TCTCRCTGTAATGCAGTGGAGG, ACATCTCRCTGTAATGCAGTGG, GACATCTCRCTGTAATGCAGTGG | Loeys-Dietz syndrome 2, not provided |
| 104893809 | TGFBR2 | NM_003242.5(TGFBR2): c.1609C>T (p.Arg537Cys) | CCCAGTGTGTGGCAGAAYGCTTC, CCAGTGTGTGGCAGAAYGCTTCA | Loeys-Dietz syndrome 2, not provided |
| 104893810 | TGFBR2 | NM_003242.5(TGFBR2): c.1582C>T (p.Arg528Cys) | CCACGACCCAGAGGCCYGTCTCA | Loeys-Dietz syndrome 2, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 35312232 | TGM1 | NM_000359.2(TGM1): c.1552G>A (p.Val518Met) | TATRTGGAGGAGAAGGCCATCGG | Autosomal recessive congenital ichthyosis 1 |
| 121918717 | TGM1 | NM_000359.2(TGM1): c.968G>A (p.Arg323Gln) | CTCCCRGGTCATCTCTGCCATGG | Autosomal recessive congenital ichthyosis 1 |
| 121918722 | TGM1 | NM_000359.2(TGM1): c.1147G>A (p.Val383Met) | GGCRTGACCACCACAGGTAGTGG | Autosomal recessive congenital ichthyosis 1 |
| 121918725 | TGM1 | NM_000359.2(TGM1): c.832G>A (p.Gly278Arg) | TACRGGACCGAAGCACAGATTGG | Autosomal recessive congenital ichthyosis 1 |
| 121918727 | TGM1 | NM_000359.2(TGM1): c.857G>A (p.Arg286Gln) | GGTGAGCRGACCTGGAACTACGG | Autosomal recessive congenital ichthyosis 1 |
| 398122904 | TGM1 | NM_000359.2(TGM1): c.2278C>T (p.Arg760Ter) | CCAGTCGTTTGTGCCTGTGYGAC | Autosomal recessive congenital ichthyosis 1 |
| 372250159 | TGM6 | NM_198994.2(TGM6): c.331C>T (p.Arg111Cys) | CCCAGTGCTGTCATTGGCYGCTA, CCAGTGCTGTCATTGGCYGCTAC | Spinocerebellar ataxia 35 |
| 121917764 | TH | NM_199292.2(TH): c.941C>T (p.Thr314Met) | CCCCTTGCAGAGCGCAYGGGCTT, CCCTTGCAGAGCGCAYGGGCTTC, CCTTGCAGAGCGCAYGGGCTTCC | Segawa syndrome, autosomal recessive |
| 121918694 | THRB | NM_001128177.1(THRB): c.700G>A (p.Ala234Thr) | CCAACRCCCAAGGCAGCCACTGG | Thyroid hormone resistance, generalized, autosomal dominant |
| 121918698 | THRB | NM_001128177.1(THRB): c.1313G>A (p.Arg438His) | CAGCCRCTTCCTGCACATGAAGG | Thyroid hormone resistance, generalized, autosomal dominant |
| 121918696 | THRB | NM_001128177.1(THRB): c.958C>T (p.Arg320Cys) | CCCTTCGCGCTGCTGTGYGCTAT, CCTTCGCGCTGCTGTGYGCTATG | Thyroid hormone resistance, generalized, autosomal dominant |
| 121918707 | THRB | NM_001128177.1(THRB): c.727C>T (p.Arg243Trp) | CCACTGGAAGCAAAAAYGGAAAT | Thyroid hormone resistance, generalized, autosomal dominant |
| 1054894 | TIMM8A | NM_004085.3(TIMM8A): c.238C>T (p.Arg80Ter) | CCAGTTCATCTTGAATYGACTGG | Mohr-Tranebjaerg syndrome |
| 80356559 | TIMM8A | NM_004085.3(TIMM8A): c.112C>T (p.Gln38Ter) | CCAGCAGCTGGTGCACYAGATGA | Mohr-Tranebjaerg syndrome |
| 199422321 | TINF2 | NM_001099274.1(TINF2): c.706C>T (p.Pro236Ser) | CCCCTGCCAAAAGCCAAGYCTGG, CCCTGCCAAAAGCCAAGYCTGGC, CCTGCCAAAAGCCAAGYCTGGCA | Dyskeratosis congenita, autosomal dominant |
| 387907154 | TINF2 | NM_001099274.1(TINF2): c.811C>T (p.Gln271Ter) | CCGACGAAGAGTTCAGTCCYAAT | Dyskeratosis congenita, autosomal dominant, 3 |
| 281865496 | TK2 | NM_004614.4(TK2): c.575G>A (p.Arg192Lys) | AGARGTTAAAGAAGAGATGCAGG | Mitochondrial DNA depletion syndrome 2 |
| 281865489 | TK2 | NM_004614.4(TK2): c.268C>T (p.Arg90Cys) | CCAAGTGGAGAAATGTCYGTGGC | Mitochondrial DNA depletion syndrome 2 |
| 281865493 | TK2 | NM_004614.4(TK2): c.388C>T (p.Arg130Trp) | CCTTTAGGTGTCATCTGTAYGGT | Mitochondrial DNA depletion syndrome 2 |
| 137854431 | TK2 | NM_004614.4(TK2): c.323C>T (p.Thr108Met) | CCTCTCGCTGGGGTCTTAYGCTA | Mitochondrial DNA depletion syndrome 2, not provided |
| 121908327 | TMC6 | NM_007267.6(TMC6): c.280C>T (p.Arg94Ter) | CCTCCATAGGCCGCAGCYGAGGT, CCATAGGCCGCAGCYGAGGTGCC | Epidermodysplasia verruciformis |
| 387907134 | TMEM138 | NM_016464.4(TMEM138): c.376G>A (p.Ala126Thr) | ACTARGTAAGGACCAGAGCAAGG | Joubert syndrome 16 |
| 387907133 | TMEM138 | NM_016464.4(TMEM138): c.380C>T (p.Ala127Val) | CCTCCCACAGCAGYAGTGTTGT | Joubert syndrome 16 |
| 387907221 | TMEM165 | NM_018475.4(TMEM165): c.377G>A (p.Arg126His) | AACCRCCTGACCGTGCTGGCTGG, CTATAACCRCCTGACCGTGCTGG | Congenital disorder of glycosylation type 2k |
| 587777610 | TMEM173 | NM_198282.3(TMEM173): c.463G>A (p.Val155Met) | CCAGCCCATGGGCAYGTTGAAA | Sting-associated vasculopathy, infantile-onset |
| 199469707 | TMEM237 | NM_001044385.2(TMEM237): c.52C>T (p.Arg18Ter) | CCGCCACAGCGTCCTCCAYGAGC, CCACAGCGTCCTCCAYGAGCTCT | Familial aplasia of the vermis, Joubert syndrome 14 |
| 606231454 | TMEM240 | NM_001114748.1(TMEM240): c.239C>T (p.Thr80Met) | CCGAGAACTACTTTGTGAYGGAC | Spinocerebellar ataxia 21 |
| 606231453 | TMEM240 | NM_001114748.1(TMEM240): c.346C>T (p.Arg116Cys) | CCTGCACTGCGCCGTGYGCGCCT | Spinocerebellar ataxia 21 |
| 63750743 | TMEM43 | NM_024334.2(TMEM43): 1073C>T (p.Ser358Leu) | CCTTCTGTGTGGCCACCTYGCTG | Arrhythmogenic right ventricular cardiomyopathy, Arrhythmogenic right ventricular cardiomyopathy, type 5, not provided |
| 267607114 | TMEM67 | NM_001142301.1(TMEM67): c.1391G>A (p.Gly464Glu) | CAGRATGGAAGAGGCGCATTGGG, GCAGRATGGAAGAGGCGCATTGG | Joubert syndrome 6 |
| 267607118 | TMEM67 | NM_153704.5(TMEM67): c.130C>T (p.Gln44Ter) | CCTTCTCTTTCCCTTTCYAGCAG | Joubert syndrome 6 |
| 28941781 | TMIE | NM_147196.2(TMIE): c.274C>T (p.Arg92Trp) | CCGGAAGGAGATCGAAGCCYGGT | Deafness, autosomal recessive 6 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908059 | TMPRSS15 | NM_002772.2(TMPRSS15): c.2569C>T (p.Arg857Ter) | CCTCAAACAGTCCCTYGATTAAT | Enterokinase deficiency |
| 181949335 | TMPRSS3 | NM_024022.2(TMPRSS3): c.916G>A (p.Ala306Thr) | CCGGCCAGCTTCATAAGGGYGAT, CCAGCTTCATAAGGGYGATGTCA | Deafness, autosomal recessive 8 |
| 374793617 | TMPRSS3 | NM_024022.2(TMPRSS3): c.323-6G>A | CCACCCACCCGGACTGGCYGATG, CCCACCCGGACTGGCYGATGTGC, CCACCCGGACTGGCYGATGTGCA | Deafness, autosomal recessive 8 |
| 137853119 | TMPRSS6 | NM_153609.3(TMPRSS6): c.1324G>A (p.Gly442Arg) | CCTCACCRGGCCCGGTGTGCGGG, CCCTCACCRGGCCCGGTGTGCGG | Microcytic anemia |
| 137853120 | TMPRSS6 | NM_153609.3(TMPRSS6): c.1561G>A (p.Asp521Asn) | CAGCRACGAAGAGCAGTGCCAGG | Microcytic anemia |
| 387907018 | TMPRSS6 | NM_153609.3(TMPRSS6): c.1564G>A (p.Glu522Lys) | GACRAAGAGCAGTGCCAGGAAGG, CAGCGACRAGAGCAGTGCCAGG | Microcytic anemia |
| 137853123 | TMPRSS6 | NM_153609.3(TMPRSS6): c.1795C>T (p.Arg599Ter) | CCTCCAGGTTCGGGGTYGACACA | Microcytic anemia |
| 281865419 | TNF | NM_000594.3(TNF): c.322C>T (p.Arg108Trp) | CCAGTGGCTGAACCGCYGGGCCA | |
| 104895222 | TNFRSF1A | NM_001065.3(TNFRSF1A): c.350G>A (p.Cys117Tyr) | CTCTTCTTRCACAGTGGACCGGG | TNF receptor-associated periodic fever syndrome (TRAPS) |
| 104895218 | TNFRSF1A | NM_001065.3(TNFRSF1A): c.185G>A (p.Cys62Tyr) | ACCAAGTRCCACAAAGGTAGGGG, TACCAAGTRCCACAAAGGTAGGG | TNF receptor-associated periodic fever syndrome (TRAPS) |
| 587777075 | TNFRSF4 | NM_003327.3(TNFRSF4): c.193C>T (p.Arg65Cys) | CGGACRGCACACCGTGTTCTGGG, ACGGACRGCACACCGTGTTCTGG | Immunodeficiency 16 |
| 104894312 | TNNI2 | NM_003282.3(TNNI2): c.466C>T (p.Arg156Ter) | CCACAGGAGCGGGACCTGYGAGA | Distal arthrogryposis type 2B, not provided |
| 727503503 | TNNI3 | NM_000363.4(TNNI3): c.509G>A (p.Arg170Gln) | CCTGCRGGCCCACCTCAAGCAGG | Familial restrictive cardiomyopathy 1, Cardiomyopathy, Familial hypertrophic cardiomyopathy 7 |
| 397516355 | TNNI3 | NM_000363.4(TNNI3): c.544G>A (p.Glu182Lys) | GACACCRAGAAGGTGAGTGTGGG, GGACACCRAGAAGGTGAGTGTGG | Dilated cardiomyopathy 1FF, Cardiomyopathy |
| 397516357 | TNNI3 | NM_000363.4(TNNI3): c.557G>A (p.Arg186Gln) | AAAACCRGGAGGTGGGAGACTGG | Primary familial hypertrophic cardiomyopathy, Cardiomyopathy, Hypertrophic cardiomyopathy, Familial hypertrophic cardiomyopathy 7 |
| 121917761 | TNNI3 | NM_000363.4(TNNI3): c.511G>A (p.Ala171Thr) | CCTGCGGRCCCACCTCAAGCAGG | Familial restrictive cardiomyopathy 1, not specified |
| 730881069 | TNNI3 | NM_000363.4(TNNI3): c.407G>A (p.Arg136Gln) | ACCTTCRAGGCAAGTTTAAGCGG | Cardiomyopathy, Hypertrophic cardiomyopathy |
| 727504242 | TNNI3 | NM_000363.4(TNNI3): c.497C>T (p.Ser166Phe) | CCCGGGCTAAGGAGTYCCTGGAC, CCGGGCTAAGGAGTYCCTGGACC | Cardiomyopathy, not specified |
| 267607128 | TNNI3 | NM_000363.4(TNNI3): c.61C>T (p.Arg21Cys) | CCAGCCCCAATCAGAYGCCGCTC | Familial hypertrophic cardiomyopathy 7 |
| 727504247 | TNNT2 | NM_001001430.2(TNNT2): c.860G>A (p.Trp287Ter) | CGGGCGCTRGAAATAGAGCCTGG | Familial hypertrophic cardiomyopathy 2, Cardiomyopathy |
| 121964856 | TNNT2 | NM_001001430.2(TNNT2): c.275G>A (p.Arg92Gln) | CCACCRGAAGCGCATGGAGAAGG | Familial hypertrophic cardiomyopathy 2, Cardiomyopathy |
| 45501500 | TNNT2 | NM_001001430.2(TNNT2): c.476G>A (p.Arg159Gln) | GACRAGAGGAGGAGGAGAACAGG | Cardiomyopathy, not specified |
| 730881101 | TNNT2 | NM_001001430.2(TNNT2): c.422G>A (p.Arg141Gln) | CATCCRGAATGAGCGGGAGAAGG | Cardiomyopathy |
| 121964857 | TNNT2 | NM_000364.3(TNNT2): c.853C>T (p.Arg285Cys) | CCCCTGCAGCTCCAAGACCYGCG, CCCTGCAGCTCCAAGACCYGCGG, CCTGCAGCTCCAAGACCYGCGGG | Costello syndrome, Primary familial hypertrophic cardiomyopathy, Familial hypertrophic cardiomyopathy 2, Familial hypertrophic cardiomyopathy 1, Cardiomyopathy, not specified |
| 397516456 | TNNT2 | NM_001001430.2(TNNT2): c.274C>T (p.Arg92Trp) | CCACCCACAGGACATCCACYGGA, CCCACAGGACATCCACYGGAAGC, CCACAGGACATCCACYGGAAGCG | Familial hypertrophic cardiomyopathy 2, Cardiomyopathy |
| 727504245 | TNNT2 | NM_001001430.2(TNNT2): c.311C>T (p.Ala104Val) | CCTGAATGAGTTGCAGGYGCTGA | Familial hypertrophic cardiomyopathy 2, Cardiomyopathy, not specified |
| 74315380 | TNNT2 | NM_001001430.2(TNNT2): c.391C>T (p.Arg131Trp) | CCTTAGGAGAGACGTYGGGCAGA | Primary dilated cardiomyopathy, Left ventricular noncompaction 6, Cardiomyopathy |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777682 | TNXB | NM_019105.6(TNXB): c.12214C>T (p.Arg4072Cys) | CATGCGGCRCTGGAACACCTGGG | Ehlers-Danlos-like syndrome due to tenascin-X deficiency |
| 587777684 | TNXB | NM_019105.6(TNXB): c.3991G>A (p.Gly1331Arg) | CCTGCCACGAAGCCYGTAGAGGT | Vesicoureteral reflux 8 |
| 121912652 | TP53 | NM_000546.5(TP53): c.772G>A (p.Glu258Lys) | ACACTGRAAGACTCCAGGTCAGG | Li-Fraumeni syndrome 1, Hereditary cancer-predisposing syndrome |
| 587778720 | TP53 | NM_000546.5(TP53): c.638G>A (p.Arg213Gln) | CACTTTTCRACATAGTGTGGTGG | Li-Fraumeni syndrome, Li-Fraumeni syndrome 1, Hereditary cancer-predisposing syndrome, not specified |
| 587781288 | TP53 | NM_000546.5(TP53): c.422G>A (p.Cys141Tyr) | GACCTRCCCTGTGCAGCTGTGGG, AGACCTRCCCTGTGCAGCTGTGG | Hereditary cancer-predisposing syndrome |
| 121913344 | TP53 | NM_000546.5(TP53): c.916C>T (p.Arg306Ter) | CCCCCAGGGAGCACTAAGYGAGG, CCCCAGGGAGCACTAAGYGAGGT, CCCAGGGAGCACTAAGYGAGGTA, CCAGGGAGCACTAAGYGAGGTAA | Hereditary cancer-predisposing syndrome |
| 397516435 | TP53 | NM_000546.5(TP53): c.586C>T (p.Arg196Ter) | CCCTCCTCAGCATCTTATCYGAG, CCTCCTCAGCATCTTATCYGAGT, CCTCAGCATCTTATCYGAGTGGA | Li-Fraumeni syndrome 1, Hereditary cancer-predisposing syndrome |
| 587780071 | TP53 | NM_000546.5(TP53): c.580C>T (p.Leu194Phe) | CCCCTCCTCAGCATYTTATCCGA | Hereditary cancer-predisposing syndrome |
| 730882001 | TP53 | NM_000546.5(TP53): c.493C>T (p.Gln165Ter) | CCATGGCCATCTACAAGYAGTCA | Hereditary cancer-predisposing syndrome |
| 121908841 | TP63 | NM_003722.4(TP63): c.1028G>A (p.Arg343Gln) | GCCCRGATCTGTGCTTGCCCAGG | Ectrodactyly, ectodermal dysplasia, and cleft lip/palate syndrome 3 |
| 113993967 | TP63 | NM_003722.4(TP63): c.1010G>A (p.Arg337Gln) | GCCRACGCTGCTTTGAGGCCCGG, CCTGGGCCRACGCTGCTTTGAGG | ADULT syndrome |
| 121964846 | TPI1 | NM_001159287.1(TPI1): c.478G>A (p.Gly160Arg) | CTCRGAGTAATCGCCTGCATTGG | |
| 104894503 | TPM1 | NM_001018005.1(TPM1): c.523G>A (p.Asp175Asn) | GAGCRACCTGGAACGTGCAGAGG | Primary familial hypertrophic cardiomyopathy, Familial hypertrophic cardiomyopathy 3, Sudden cardiac death, Cardiomyopathy |
| 397516382 | TPM1 | NM_001018005.1(TPM1): c.64G>A (p.Ala22Thr) | GGATCGARCTGAGCAGGCGGAGG | Cardiomyopathy, not specified |
| 199476317 | TPM1 | NM_001018005.1(TPM1): c.688G>A (p.Asp230Asn) | CCTTTCCRACAAGCTGAAGGAGG | Dilated cardiomyopathy 1Y, Cardiomyopathy, not provided |
| 199474717 | TPM3 | NM_152263.3(TPM3): c.721G>A (p.Glu241Lys) | TGCTRAGTTTGCTGAGAGATCGG | Congenital myopathy with fiber type disproportion, not provided |
| 199474711 | TPM3 | NM_152263.3(TPM3): c.11C>T (p.Ala4Val) | CCACTGCTCATGATGGAGGYCAT | Congenital myopathy with fiber type disproportion, not provided |
| 121908195 | TPP1 | NM_000391.3(TPP1): c.229G>A (p.Gly77Arg) | TACRGTGCCTTTTGGGACTGAGG | Ceroid lipofuscinosis, neuronal, 2 |
| 119455954 | TPP1 | NM_000391.3(TPP1): c.1094G>A (p.Cys365Tyr) | GCCGGGTRTTGGTCTGTCTCTGG | Ceroid lipofuscinosis, neuronal, 2, not provided |
| 119455956 | TPP1 | NM_000391.3(TPP1): c.1340G>A (p.Arg447His) | TGGCCRTGCCTACCCAGATGTGG | Ceroid lipofuscinosis, neuronal, 2, not provided |
| 119455955 | TPP1 | NM_000391.3(TPP1): c.622C>T (p.Arg208Ter) | CCCCTCTGTGATCCGTAAGYGAT, CCCTCTGTGATCCGTAAGYGATA, CCTCTGTGATCCGTAAGYGATAC | Ceroid lipofuscinosis, neuronal, 2, not provided |
| 28940573 | TPP1 | NM_000391.3(TPP1): c.616C>T (p.Arg206Cys) | CCCCCTCTGTGATCYGTAAGCGA | Ceroid lipofuscinosis, neuronal, 2 |
| 104894001 | TREM2 | NM_018965.3(TREM2): c.132G>A (p.Trp44Ter) | ACTGRGGGAGGCGCAAGGCCTGG | Polycystic lipomembranous osteodysplasia with sclerosing leukoencephalopathy |
| 121908117 | TREX1 | NM_016381.5(TREX1): c.217G>A (p.Asp73Asn) | TTTTTCRACATGGAGGCCACTGG | Aicardi Goutieres syndrome 1, Aicardi Goutieres syndrome 1, autosomal dominant, Chilbain lupus 1 |
| 121917847 | TRHR | NM_003301.5(TRHR): c.49C>T (p.Arg17Ter) | CCAAACACAGCTTCAGCCAYGAG | Thyrotropin-releasing hormone resistance, generalized |
| 118204027 | TRIOBP | NM_001039141.2(TRIOBP): c.1741C>T (p.Gln581Ter) | CCCCAGAACATCCTGTGCCYAGC, CCCAGAACATCCTGTGCCYAGCG, CCAGAACATCCTGTGCCYAGCGG | Deafness, autosomal recessive 28 |
| 118204028 | TRIOBP | NM_001039141.2(TRIOBP): c.889C>T (p.Gln297Ter) | CCTCATCCACCCAAYAGGAAATC | Deafness, autosomal recessive 28 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 118204031 | TRIOBP | NM_001039141.2(TRIOBP): c.3349C>T (p.Arg1117Ter) | CCTGTGTGTATTGGGTACYGAGA | Deafness, autosomal recessive 28 |
| 118204029 | TRIOBP | NM_001039141.2(TRIOBP): c.2362C>T (p.Arg788Ter) | CCCAATAGAGCCACAYGAGACAA, CCAATAGAGCCACAYGAGACAAC | Deafness, autosomal recessive 28 |
| 118203991 | TRMU | NM_018006.4(TRMU): c.815G>A (p.Gly272Asp) | TAGGTGRCCTGAGAGAGCCCTGG | Liver failure acute infantile |
| 369742878 | TRPM1 | NM_002420.5(TRPM1): c.2998C>T (p.Arg1000Ter) | TTTCRGGCCAGTTTCCAAGAGGG, GTTTCRGGCCAGTTTCCAAGAGG | Congenital stationary night blindness, type 1C, not provided |
| 201907325 | TRPM4 | NM_017636.3(TRPM4): c.1294G>A (p.Ala432Thr) | TGGACRCCCTGCTGAATGACCGG | Progressive familial heart block type 1B |
| 267607142 | TRPM4 | NM_017636.3(TRPM4): c.19G>A (p.Glu7Lys) | GAGAAGRAGCAGGTGAGCGCCGG | Progressive familial heart block type 1B |
| 121912625 | TRPM6 | NM_017662.4(TRPM6): c.422C>T (p.Ser141Leu) | CCCAAGCTTGTGATCTYAGTCCA, CCAAGCTTGTGATCTYAGTCAT | Hypomagnesemia 1, intestinal |
| 28939070 | TRPS1 | NM_014112.4(TRPS1): c.2894G>A (p.Arg965His) | AAGAAAGCRCCTTAACCCAGAGG | Trichorhinophalangeal dysplasia type I |
| 121908435 | TRPS1 | NM_014112.4(TRPS1): c.2762G>A (p.Arg921Gln) | TGGCRAAAGAATGCAAATGGCGG, CTCTGGCRAAAGAATGCAAATGG | Trichorhinophalangeal syndrome type 3 |
| 121908432 | TRPS1 | NM_014112.4(TRPS1): c.2557C>T (p.Arg853Ter) | CCGCCCATCTGGCGYGACCTATT | Trichorhinophalangeal dysplasia type I |
| 397514494 | TRPV4 | NM_021625.4(TRPV4): c.557G>A (p.Arg186Gln) | TTCRAGGTGAGCCACCCAGATGG | Charcot-Marie-Tooth disease type 2C, Distal spinal muscularatrophy, congenital nonprogressive |
| 77975504 | TRPV4 | NM_021625.4(TRPV4): c.1781G>A (p.Arg594His) | CCCRTGGGCTGAAGCTGACGGGG, ACCCRTGGGCTGAAGCTGACGGG, CACCCRTGGGCTGAAGCTGACGG | Spondylometaphyseal dysplasia, Kozlowski type, Parastremmatic dwarfism |
| 387906905 | TRPV4 | NM_021625.4(TRPV4): c.947G>A (p.Arg316His) | ATGCGGCRCCAGGACTCGCGAGG | Charcot-Marie-Tooth disease type 2C |
| 267607143 | TRPV4 | NM_021625.4(TRPV4): c.943C>T (p.Arg315Trp) | CCACAAGAAGGCGGACATGYGGC | Charcot-Marie-Tooth disease type 2C, Charcot-Marie-Tooth disease, Scapuloperoneal spinal muscular atrophy, Distal spinal muscular atrophy, congenital nonprogressive |
| 387906906 | TRPV4 | NM_021625.4(TRPV4): c.2219C>T (p.Thr740Ile) | CCCCGCAGTGGGCCACCAYCATC, CCCGCAGTGGGCCACCAYCATCC, CCGCAGTGGGCCACCAYCATCCT | Metatrophic dysplasia |
| 118203387 | TSC1 | NM_000368.4(TSC1): c.491G>A (p.Trp164Ter) | TCATRGTGCCTGAAGAAACCAGG | Tuberous sclerosis syndrome, Lymphangiomyomatosis, not provided |
| 118203427 | TSC1 | NM_000368.4(TSC1): c.682C>T (p.Arg228Ter) | CCAATGATGGAGCATGTGYGAAT | Tuberous sclerosis syndrome, Tuberous sclerosis 1, not provided |
| 28934872 | TSC2 | NM_000548.3(TSC2): c.1832G>A (p.Arg611Gln) | GCATCCRGCTGCAGGTATGGTGG | Tuberous sclerosis syndrome, Lymphangiomyomatosis, Tuberous sclerosis 2 |
| 45515894 | TSC2 | NM_000548.3(TSC2): c.1322G>A (p.Trp441Ter) | CGGCTRGATTCAGAACCTGCAGG | Tuberous sclerosis syndrome, Tuberous sclerosis 2 |
| 45517150 | TSC2 | NM_000548.3(TSC2): c.976-15G>A | GCTGGCCRGGCTCGTGTTCCAGG | Tuberous sclerosis syndrome, not provided |
| 45466296 | TSC2 | NM_000548.3(TSC2): c.848+1G>A | ACAGRTGAGTGTGGTGGGTGGGG, GACAGRTGAGTGTGGTGGGTGGG, GGACAGRTGAGTGTGGTGGGTGG | Tuberous sclerosis syndrome, Tuberous sclerosis 2, not provided |
| 45483392 | TSC2 | NM_000548.3(TSC2): c.5024C>T (p.Pro1675Leu) | CCACGTGATCGTCACCCYGCTGG | Tuberous sclerosis syndrome, Lymphangiomyomatosis, Tuberous sclerosis 2 |
| 45517340 | TSC2 | NM_000548.3(TSC2): c.4375C>T (p.Arg1459Ter) | CCCAGTGGCCTCCGGCCCYGAGG, CCAGTGGCCTCCGGCCCYGAGGT | Tuberous sclerosis syndrome, Tuberous sclerosis 2, not provided |
| 113994153 | TSEN54 | NM_207346.2(TSEN54): c.736C>T (p.Gln246Ter) | CCCAGAGGAGAAACCCYAGGAGT, CCAGAGGAGAAACCCYAGGAGTC | Pontocerebellar hypoplasia type 4 |
| 587777688 | TSFM | NM_005726.5(TSFM): c.944G>A (p.Cys315Tyr) | TGAATRTGGAGAAGGTGAAGAGG | Combined oxidative phosphorylation deficiency 3 |
| 121918668 | TSHB | NM_000549.4(TSHB): c.145G>A (p.Gly49Arg) | TGCTRGATATTGTATGACACGGG, GTGCTRGATATTGTATGACACGG | Secondary hypothyroidism |
| 121918670 | TSHB | NM_000549.4(TSHB): c.205C>T (p.Gln69Ter) | CCCAAATATGCTCTGTCCYAGGA, CCAAATATGCTCTGTCCYAGGAT | Secondary hypothyroidism |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908881 | TSHR | NM_000369.2(TSHR): c.1430C>T (p.Thr477Ile) | CCTCTGTAGACCTCTACAYTCAC | Hypothyroidism, congenital, nongoitrous, 1 |
| 387907094 | TTC19 | NM_017775.3(TTC19): c.517C>T (p.Gln173Ter) | CCTTGGAGGGGGCATGAAGYAGG | Mitochondrial complex III deficiency, nuclear type 2 |
| 786205698 | TTC7A | NM_001288953.1(TTC7A): c.1474C>T (p.Gln492Ter) | CCCCACACAGGGCTCAGYAGCTG, CCCACACAGGGCTCAGYAGCTGG, CCACACAGGGCTCAGYAGCTGGC | Multiple gastrointestinal atresias |
| 138060032 | TTN | NM_001256850.1(TTN): c.835C>T (p.Arg279Trp) | CTGCCRAGCCAGCTGTGCTTTGG | Hereditary myopathy with early respiratory failure, not provided |
| 372277017 | TTN | NM_133378.4(TTN): c.12064C>T (p.Arg4022Ter) | GCTCRCTCAATGATTTTGGCAGG, TTCTGCTCRCTCAATGATTTTGG | Distal myopathy Markesbery-Griggs type |
| 397515524 | TTPA | NM_000370.3(TTPA): c.421G>A (p.Glu141Lys) | ATCCRAGCTTATTGTACAGGAGG, CACATCCRAGCTTATTGTACAGG | Ataxia with vitamin E deficiency |
| 76992529 | TTR | NM_000371.3(TTR): c.424G>A (p.Val142Ile) | GGCTGTCRTCACCAATCCCAAGG | Amyloidogenic transthyretin amyloidosis, Amyloid Cardiomyopathy, Transthyretin-related, Cardiomyopathy, not provided |
| 121918086 | TTR | NM_000371.3(TTR): c.241G>A (p.Glu81Lys) | ACTRAGGAGGAATTTGTAGAAGG | Amyloidogenic transthyretin amyloidosis |
| 753719501 | TUBA1A | NM_006009.3(TUBA1A): c.1224C>A (p.Tyr408Ter) | CCCAACRTACCAGTGAACAAAGG | Lissencephaly 3 |
| 137853043 | TUBA1A | NM_006009.3(TUBA1A): c.790C>T (p.Arg264Cys) | CCTGGTGCCCTATCCCYGCATCC | Lissencephaly 3 |
| 730880027 | TUBA4A | NM_006000.2(TUBA4A): c.1220G>A (p.Trp407Ter) | GTGCACTRGTATGTGGGTGAGGG, TGTGCACTRGTATGTGGGTGAGG | Amyotrophic lateral sclerosis 22 with or without frontotemporal dementia |
| 368743618 | TUBA4A | NM_006000.2(TUBA4A): c.1147G>A (p.Ala383Thr) | CCCAGGCCTCGGCGATGGYGGTC, CCAGGCCTCGGCGATGGYGGTCG | Amyotrophic lateral sclerosis 22 with or without frontotemporal dementia |
| 730880025 | TUBA4A | NM_006000.2(TUBA4A): c.958C>T (p.Arg320Cys) | CCTGCTGCCTGCTGTACYGTGGA | Amyotrophic lateral sclerosis 22 with or without frontotemporal dementia |
| 587777357 | TUBB | NM_178014.3(TUBB): c.1201G>A (p.Glu401Lys) | AGGCRAGGGCATGGACGAGATGG | Cortical dysplasia, complex, with other brain malformations 6 |
| 587777324 | TUBB2A | NM_001069.2(TUBB2A): c.743C>T (p.Ala248Val) | GGTCTRCGTTCAGCTGGCCCGGG, AGGTCTRCGTTCAGCTGGCCCGG | Cortical dysplasia, complex, with other brain malformations 5 |
| 398122369 | TUBB2B | NM_178012.4(TUBB2B): c.1261G>A (p.Glu421Lys) | GTCCRAGTACCAGCAGTACCAGG | Polymicrogyria, asymmetric |
| 267607163 | TUBB3 | NM_001197181.1(TUBB3): c.688G>A (p.Ala230Thr) | GCCRCCTGCGACCCGCGCCACGG | Fibrosis of extraocular muscles, congenital, 3a, with or without extraocular involvement |
| 483352809 | TUBB4A | NM_006087.3(TUBB4A): c.745G>A (p.Asp249Asn) | GAACGCCRACCTGCGCAAGCTGG | Leukodystrophy, hypomyelinating, 6 |
| 587777074 | TUBB4A | NM_001289123.1(TUBB4A): c.964G>A (p.Ala322Thr) | CCCCGGCTGGTCAGGGGTGYGAA, CCCGGCTGGTCAGGGGTGYGAAG, CCGGCTGGTCAGGGGTGYGAAGC | Autosomal dominant torsion dystonia 4 |
| 121434452 | TUFM | NM_003321.4(TUFM): c.1016G>A (p.Arg339Gln) | CTTGCGGCRGGGCCTGGTCATGG | Combined oxidative phosphorylation deficiency 4 |
| 121909077 | TULP1 | NM_003322.4(TULP1): c.1444C>T (p.Arg482Trp) | CCCTCAACTTCCAAGGCYGGGTC, CCTCAACTTCCAAGGCYGGGTCA | Retinitis pigmentosa 14 |
| 121909190 | TWIST1 | NM_000474.3(TWIST1): c.556G>A (p.Ala186Thr) | GCTACRCCTTCTCGGTCTGGAGG, TCAGCTACRCCTTCTCGGTCTGG | Craniosynostosis 1 |
| 104894065 | TWIST1 | NM_000474.3(TWIST1): c.211C>T (p.Gln71Ter) | CCGGGCAGCCCGGCCYAGGGCAA | Robinow Sorauf syndrome |
| 387906974 | TWIST2 | NM_057179.2(TWIST2): c.193C>T (p.Gln65Ter) | CCTTCGAGGAGCTGYAGAGCCAG | Congenital ectodermal dysplasia of face |
| 727502794 | TXNL4A | NM_001305563.1(TXNL4A): c.-60-10655C>T | CCTGCACAACGGCTGGYAGGTGG | Burn-Mckeown syndrome |
| 121913037 | TYMP | NM_001113755.2(TYMP): c.433G>A (p.Gly145Arg) | TGATCAGCRGACGTGGTCTGGGG | |
| 121913038 | TYMP | NM_001113755.2(TYMP): c.457G>A (p.Gly153Ser) | AGGARGCACCTTGGATAAGCTGG | |
| 28940880 | TYR | NM_000372.4(TYR): c.616G>A (p.Ala206Thr) | AAGCACCRACTTTTCTGCCTTGG | Tyrosinase-negative oculocutaneous albinism, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 61753180 | TYR | NM_000372.4(TYR): c.140G>A (p.Gly47Asp) | TGTGRCCAGCTTTCAGGCAGAGG | Tyrosinase-negative oculocutaneous albinism, Oculocutaneous albinism type 1B, not provided |
| 137854890 | TYR | NM_000372.4(TYR): c.272G>A (p.Cys91Tyr) | CAGTRCTCTGGCAACTTCATGGG, CCAGTRCTCTGGCAACTTCATGG | Tyrosinase-negative oculocutaneous albinism |
| 28940876 | TYR | NM_000372.4(TYR): c.242C>T (p.Pro81Leu) | CCGGGAGTCGTGGCYTTCCGTCT | Tyrosinase-negative oculocutaneous albinism, Oculocutaneous albinism type 1B, not provided |
| 61753178 | TYR | NM_000372.4(TYR): c.61C>T (p.Pro21Ser) | CCTCCGCTGGCCATTTCYCTAGA, CCGCTGGCCATTTCYCTAGAGCC | Tyrosinase-negative oculocutaneous albinism, not provided |
| 104894313 | TYR | NM_000372.4(TYR): c.1217C>T (p.Pro406Leu) | CCGAAGGCACCGTCYTCTTCAAG | Oculocutaneous albinism type 1B, not provided |
| 80356547 | UBA1 | NM_003334.3(UBA1): c.1731C>T (p.Asn577=) | CCAATGCCCTGGACAAYGTGGAT | Arthrogryposis multiplex congenita, distal, X-linked |
| 387906710 | UBQLN2 | NM_013444.3(UBQLN2): c.1489C>T (p.Pro497Ser) | CCCTGTAGGCCCAGTCACCYCCA, CCTGTAGGCCCAGTCACCYCCAT | Amyotrophic lateral sclerosis 15, with or without frontotemporal dementia |
| 387906712 | UBQLN2 | NM_013444.3(UBQLN2): c.1525C>T (p.Pro509Ser) | CCCTATAGTCCCTTTTACCYCCA, CCTATAGTCCCTTTTACCYCCAT | Amyotrophic lateral sclerosis 15, with or without frontotemporal dementia |
| 17848368 | UCP3 | NM_003356.3(UCP3): c.208C>T (p.Arg70Trp) | CCATCCTGACCATGGTGYGGACT | |
| 28934582 | UMOD | NM_003361.3(UMOD): c.443G>A (p.Cys148Tyr) | TGGCACTRTGAGTGCTCCCCGGG, ATGGCACTRTGAGTGCTCCCCGG | Familial juvenile gout |
| 398123698 | UMOD | NM_003361.3(UMOD): c.944G>A (p.Cys315Tyr) | ATGGCACTRCCAGTGCAAACAGG | not provided |
| 777759523 | UNC13D | NM_199242.2(UNC13D): c.1389+1G>A | CCCCAGCGCGAGTACCATAYCTG, CCCAGCGCGAGTACCATAYCTGC, CCAGCGCGAGTACCATAYCTGCA | Hemophagocytic lymphohistiocytosis, familial, 3 |
| 11544803 | UQCRQ | NM_014402.4(UQCRQ): c.134C>T (p.Ser45Phe) | CCGCATTCGGGAGTYTTTCTTTC | Mitochondrial complex III deficiency, nuclear type 4 |
| 137852795 | UROC1 | NM_001165974.1(UROC1): c.1528C>T (p.Arg510Cys) | CCAGGGATTTGGGCCTTTCYGCT | Urocanate hydratase deficiency |
| 121918066 | UROD | NM_000374.4(UROD): c.995G>A (p.Arg332His) | CATCRCTACATTGCCAACCTGGG, ACATCRCTACATTGCCAACCTGG | Familial porphyria cutanea tarda |
| 397514765 | UROD | NM_000374.4(UROD): c.346C>T (p.Gln116Ter) | CCATTAAGAGAAGAGYAGGACCT | Porphyria cutanea tarda |
| 121918064 | UROD | NM_000374.4(UROD): c.583C>T (p.Leu195Phe) | CCAGCTGCTTCGCATCYTCACTG | Familial porphyria cutanea tarda |
| 397515349 | UROS | NM_000375.2(UROS): c.-26-183G>A | CTTGRCCTTATCAGTGACAGGGG, TCTTGRCCTTATCAGTGACAGGG, TTCTTGRCCTTATCAGTGACAGG | Congenital erythropoietic porphyria |
| 121908014 | UROS | NM_000375.2(UROS): c.683C>T (p.Thr228Met) | CCATCGGCCCCACTAYGGCTCGC | Congenital erythropoietic porphyria |
| 121908015 | UROS | NM_000375.2(UROS): c.10C>T (p.Leu4Phe) | CCAGGCAATAATGAAGGTTYTTT | Congenital erythropoietic porphyria |
| 104894652 | USH1G | NM_173477.4(USH1G): c.113G>A (p.Trp38Ter) | ACTCTCTRGGCTGCCTACCATGG | Usher syndrome, type 1G |
| 397517974 | USH2A | NM_206933.2(USH2A): c.1143+1G>A | TCAGRTAATGAGAAACGATAAGG | Usher syndrome, type 2A |
| 111033386 | USH2A | NM_206933.2(USH2A): c.6224G>A (p.Trp2075Ter) | CTCCTRGAACCCACCCAAAAAGG | Usher syndrome, type 2A |
| 121912599 | USH2A | NM_206933.2(USH2A): c.956G>A (p.Cys319Tyr) | TACTRCATTCCTAATGATGCAGG | Usher syndrome, type 2A |
| 146733615 | USH2A | NM_206933.2(USH2A): c.14803C>T (p.Arg4935Ter) | CTCRGTACTGAGGCACTGTGGGG, GCTCRGTACTGAGGCACTGTGGG, GGCTCRGTACTGAGGCACTGTGG | Usher syndrome, type 2A, Retinitis pigmentosa 39 |
| 397517983 | USH2A | NM_206933.2(USH2A): c.12868C>T (p.Gln4290Ter) | CCTGGATCCCACCAGAAYAGTCT | Usher syndrome, type 2A |
| 199605265 | USH2A | NM_206933.2(USH2A): c.12575G>A ) (p.Arg4192His | CCCTCGAAGCATCTGYGAATCAC, CCTCGAAGCATCTGYGAATCACT | Retinitis pigmentosa 39, not specified |
| 727504867 | USH2A | NM_206933.2(USH2A): c.14248C>T (p.Gln4750Ter) | CCATGTGATCTCTTCTACCYAAG | Usher syndrome, type 2A |
| 121918218 | VANGL1 | NM_138959.2(VANGL1): c.715G>A (p.Val239Ile) | CCATCRTCCTGCTGGAGCTCAGG | Caudal regression syndrome |
| 121909791 | VDR | NM_001017535.1(VDR): c.218G>A (p.Arg73Gln) | GGACAACCRACGCCACTGCCAGG | Vitamin D-dependent rickets, type 2 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909793 | VDR | NM_001017535.1(VDR): c.239G>A (p.Arg80Gln) | CTGCCRGCTCAAACGCTGTGTGG | Vitamin D-dependent rickets, type 2 |
| 121909794 | VDR | NM_001017535.1(VDR): c.149G>A (p.Arg50Gln) | CAGGCRAAGCATGAAGCGGAAGG | Vitamin D-dependent rickets, type 2 |
| 121909802 | VDR | NM_001017535.1(VDR): c.985G>A (p.Glu329Lys) | GGAGRAGCATGTCCTGCTCATGG | Vitamin D-dependent rickets, type 2 |
| 121909795 | VDR | NM_001017535.1(VDR): c.454C>T (p.Gln152Ter) | CCTACTCCGACTTCTGCYAGTTC | Vitamin D-dependent rickets, type 2 |
| 121909800 | VDR | NM_001017535.1(VDR): c.1171C>T (p.Arg391Cys) | CCAGAAGCTAGCCGACCTGYGCA | Vitamin D-dependent rickets, type 2 |
| 587777567 | VEGFC | NM_005429.4(VEGFC): c.628C>T (p.Arg210Ter) | GCATCRGCAGGAAGTGTGATTGG | Lymphedema, hereditary, id |
| 730882035 | VHL | NM_000551.3(VHL): c.482G>A (p.Arg161Gln) | AGCRATGCCTCCAGGTTGTCCGG | Hereditary cancer-predisposing syndrome |
| 730882034 | VHL | NM_000551.3(VHL): c.257C>T (p.Pro86Leu) | CCGCGCGTCGTGCTGCYCGTATG | Hereditary cancer-predisposing syndrome |
| 200370925 | VIPAS39 | NM_022067.3(VIPAS39): c.658C>T (p.Arg220Ter) | CCTGTCRCACCTCCAGCTCTCGG | Arthrogryposis, renal dysfunction, and cholestasis 2 |
| 180177366 | VPS13B | NM_017890.4(VPS13B): c.6732+1G>A | TACTACAGRTCTGTGGGTATTGG | Cohen syndrome, not provided |
| 180177356 | VPS13B | NM_017890.4(VPS13B): c.2074C>T (p.Arg692Ter) | CCTTTGCCATCCATTYGAATATT | Cohen syndrome, not provided |
| 180177370 | VPS13B | NM_017890.4(VPS13B): c.8318C>T (p.Ser2773Leu) | CCAAACAGAAATTGCCTTYGTAC | not provided |
| 121434383 | VPS33B | NM_018668.4(VPS33B): c.1594C>T (p.Arg532Ter) | CCCAGGTGCTAGAGCGGYAAGC, CCAGGTGCTAGAGCGGYAAGCT | Arthrogryposis renal dysfunction cholestasis syndrome |
| 61749398 | VWF | NM_000552.3(VWF): c.3970G>A (p.Gly1324Ser) | GACRGCTCCCACGCCTACATCGG | von Willebrand disease type 2M, not provided |
| 61749380 | VWF | NM_000552.3(VWF): c.3854C>T (p.Ser1285Phe) | CCTGCTGGATGGCTYCTCCAGGC | von Willebrand disease type 2M, not provided |
| 61751296 | VWF | NM_000552.3(VWF): c.7603C>T (p.Arg2535Ter) | CCTCATCAATGAGTGTGTCYGAG | von Willebrand disease type 3, not provided |
| 132630273 | WAS | NM_000377.2(WAS): c.134C>T (p.Thr45Met) | CCTGCTTTCCTCTCCCAGAYGCT | Thrombocytopenia, X-linked |
| 200322968 | WDPCP | NM_015910.5(WDPCP): c.160G>A (p.Asp54Asn) | CCAGAGCTCATTTACYCGCAATG | Orstavik Lindemann Solberg syndrome |
| 587777351 | WDR19 | NM_025132.3(WDR19): c.3703G>A (p.Glu1235Lys) | GATCRAGGGAATGGTCAGGTAGG, AGAAGATCRAGGGAATGGTCAGG | Nephronophthisis 13 |
| 587777350 | WDR19 | NM_025132.3(WDR19): c.682C>T (p.Gln228Ter) | CCCAGCTGATCTTGAATTTYAGC, CCAGCTGATCTTGAATTTYAGCA | Nephronophthisis 13 |
| 587777097 | WDR34 | NM_052844.3(WDR34): c.472C>T (p.Gln158Ter) | CTTRGGCTGGCGGGTAGCCCAGG | Short-rib thoracic dysplasia 11 with or without polydactyly |
| 116529882 | WDR36 | NM_139281.2(WDR36): c.1586G>A (p.Arg529Gln) | ACATCRAGGAAGTTTTGGCAAGG | Glaucoma 1, open angle, G |
| 587784553 | WDR62 | NM_001083961.1(WDR62): c.332+1G>A | CGCCAGRTAGGCTGAGGCCTGGG, CCGCCAGRTAGGCTGAGGCCTGG | Primary autosomal recessive microcephaly 2 |
| 387907082 | WDR62 | NM_001083961.1(WDR62): c.1313G>A (p.Arg438His) | CACCATTCRCTTCTGGAACTTGG | Primary autosomal recessive microcephaly 2 |
| 754099015 | WDR73 | NM_032856.3(WDR73): c.1039C>T (p.His347Tyr) | CAGGTGTRGGTGGTGACCAAAGG | Microcephaly, hiatal hernia and nephrotic syndrome |
| 587776906 | WDR81 | NM_001163809.1(WDR81): c.2567C>T (p.Pro856Leu) | CCTGTCTCCCAGGGCCTGCYCCC | Cerebellar ataxia, mental retardation, and dysequilibrium syndrome 2 |
| 28937895 | WFS1 | NM_006005.3(WFS1): c.2492G>A (p.Gly831Asp) | AGGRCCGCCTGGGCAGCAAGTGG | WFS1-Related Disorders |
| 387906931 | WFS1 | NM_006005.3(WFS1): c.2338G>A (p.Gly780Ser) | GTGRGCATGCCATTCAGCAGCGG | Wolfram-like syndrome, autosomal dominant |
| 104893880 | WFS1 | NM_006005.3(WFS1): c.676C>T (p.Gln226Ter) | CCCAAGTCCCTGCAGAAGYAGAG, CCAAGTCCCTGCAGAAGYAGAGG | Diabetes mellitus AND insipidus with optic atrophy AND deafness |
| 28937890 | WFS1 | NM_006005.3(WFS1): c.2171C>T (p.Pro724Leu) | CCATCAACATGCTCCYGTTCTTC | Diabetes mellitus AND insipidus with optic atrophy AND deafness |
| 28937892 | WFS1 | NM_006005.3(WFS1): c.1511C>T (p.Pro504Leu) | CCTCAACGTCAGCGTCCYGTGCC | Diabetes mellitus AND insipidus with optic atrophy AND deafness |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908899 | WISP3 | NM_003880.3(WISP3): c.434G>A (p.Cys145Tyr) | CTCTRTGTGAGTGGGGCCATTGG | Progressive pseudorheumatoid dysplasia |
| 111033591 | WNK1 | NM_213655.4(WNK1): c.3226C>T (p.Arg1076Ter) | CCTCAGCGTGTTTACYGAAATCG | |
| 111033592 | WNK1 | NM_213655.4(WNK1): c.2575C>T (p.Gln859Ter) | CCCAAACTCACCACTTCYAACCC, CCAAACTCACCACTTCYAACCCC | |
| 146902156 | WNT10A | NM_025216.2(WNT10A): c.649G>A (p.Asp217Asn) | CAGCCCCRACATGGGCTTCGGGG, GCAGCCCCRACATGGGCTTCGGG | Tooth agenesis, selective, 4, not provided |
| 147680216 | WNT10A | NM_025216.2(WNT10A): c.637G>A (p.Gly213Ser) | GGCRGCTGCAGCCCCGACATGGG, GGGCRGCTGCAGCCCCGACATGG | Tooth agenesis, selective, 4 |
| 104894653 | WNT3 | NM_030753.4(WNT3): c.247C>T (p.Gln83Ter) | CCAGGAGTGCCAGCACYAGTTCC | Tetraamelia, autosomal recessive |
| 786204837 | WNT5A | NM_003392.4(WNT5A): c.206G>A (p.Cys69Tyr) | CCTCTCTRCAGCCAACTGGCAGG | Robinow syndrome |
| 104893832 | WNT7A | NM_004625.3(WNT7A): c.325G>A (p.Ala109Thr) | ACCTACRCCATCATTGCCGCCGG | Fuhrmann syndrome |
| 397514643 | WNT7A | NM_004625.3(WNT7A): c.664C>T (p.Arg222Trp) | CCACACTGCCACAGTTTYGGGAG | Ulna and fibula absence of with severe limb deficiency |
| 281865550 | WRAP53 | NM_018081.2(WRAP53): c.1303G>A (p.Gly435Arg) | GAGCRGGGCTGTCTCTGTGTGGG, CGAGCRGGGCTGTCTCTGTGTGG | Dyskeratosis congenita, autosomal recessive, 3 |
| 281865548 | WRAP53 | NM_018081.2(WRAP53): c.1192C>T (p.Arg398Trp) | CCTGTGCTGGGATCTCYGGCAGT | Dyskeratosis congenita, autosomal recessive, 3 |
| 281865549 | WRAP53 | NM_018081.2(WRAP53): c.1126C>T (p.His376Tyr) | CCCACCTCTGCTTTYATCCCGAT | Dyskeratosis congenita, autosomal recessive, 3 |
| 121908446 | WRN | NM_000553.4(WRN): 3913C>T (p.Arg1305Ter) | CCCCCTTGATTTGGAGYGAGCAG, CCCTTGATTTGGAGYGAGCAGG, CCCTTGATTTGGAGYGAGCAGGC | Werner syndrome |
| 121907909 | WT1 | NM_024426.4(WT1): c.1372C>T (p.Arg458Ter) | CCAGTGTAAAACTTGTCAGYGAA | Frasier syndrome, Wilms tumor 1 |
| 72549369 | XDH | NM_000379.3(XDH): c.445C>T (p.Arg149Cys) | CCCACAGGAAATCTGTGCYGCTG, CCACAGGAAATCTGTGCYGCTGC | Deficiency of xanthine oxidase |
| 104894953 | XK | NM_021083.2(XK): c.941G>A (p.Trp314Ter) | CCATAATTRGTACCAGCTACTGG | McLeod neuroacanthocytosis syndrome |
| 201818754 | XYLT1 | NM_022166.3(XYLT1): c.1588-3C>T | GAAGGACTRCAGGGGAGAGAGGG | Desbuquois dysplasia 2 |
| 587777367 | XYLT1 | NM_022166.3(XYLT1): c.1792C>T (p.Arg598Cys) | TGCRGGCAAAGAAGGTAGGCCGG, AACTTGCRGGCAAAGAAGGTAGG | Desbuquois dysplasia 2 |
| 587777368 | XYLT1 | NM_022166.3(XYLT1): c.439C>T (p.Arg147Ter) | TCTGTTCRCACTTTCTCTTTCGG | Desbuquois dysplasia 2 |
| 587777249 | YAP1 | NM_001130145.2(YAP1): c.370C>T (p.Arg124Ter) | CCTGACTCCACAGCATGTTYGAG | Congenital ocular coloboma |
| 121908833 | YARS | NM_003680.3(YARS): c.121G>A (p.Gly41Arg) | TACTGGRGAACGGCAACCACGGG, TTACTGGRGAACGGCAACCACGG | Charcot-Marie-Tooth disease, dominant intermediate C |
| 113994173 | ZAP70 | NM_001079.3(ZAP70): c.837+121G>A | CTGTCTCTRGGAGTCCTCAGTGG | Severe combined immunodeficiency, atypical |
| 137853201 | ZAP70 | NM_001079.3(ZAP70): c.1394G>A (p.Arg465His) | GGCGGCCCRCAACGTCCTGCTGG | Severe combined immunodeficiency, atypical |
| 113994174 | ZAP70 | NM_001079.3(ZAP70): c.1393C>T (p.Arg465Cys) | CCGTGACCTGGCGGCCYGCAACG | Severe combined immunodeficiency, atypical |
| 483353070 | ZBTB20 | NM_001164342.2(ZBTB20): c.1861C>T (p.Leu621Phe) | CCTTAAAGGATTACYTTATCAAG | Primrose syndrome |
| 387907106 | ZBTB24 | NM_014797.2(ZBTB24): c.1369C>T (p.Arg457Ter) | CCCACATCAGAATCCATYGGTAA, CCACATCAGAATCCATYGGTAAA | Immunodeficiency-centromeric instability-facial anomalies syndrome 2 |
| 730882163 | ZBTB42 | NM_001137601.2(ZBTB42): c.1190G>A (p.Arg397His) | AGCRCCGTTTCACGCAGTCCGGG, GAGCRCCGTTTCACGCAGTCCGG | Lethal congenital contracture syndrome 6 |
| 587784563 | ZEB2 | NM_014795.3(ZEB2): c.1956C>T (p.Tyr652=) | CCCCATCAACCCATAYAAGGACC, CCCATCAACCCATAYAAGGACCA | Mowat-Wilson syndrome |
| 587784566 | ZEB2 | NM_014795.3(ZEB2): c.2761C>T (p.Arg921Ter) | CCAGTATTCCTGGGCTAYGACCA | Mowat-Wilson syndrome |
| 587784571 | ZEB2 | NM_014795.3(ZEB2): c.904C>T (p.Arg302Ter) | CCATCTGAAAGAACACCTGYGAA | Mowat-Wilson syndrome, not provided |
| 387907057 | ZFYVE26 | NM_015346.3(ZFYVE26): c.5422C>T (p.Gln1808Ter) | CCCCCTGCCAGGCACYAGTGGGT, CCCCTGCCAGGCACYAGTGGGTA | Spastic paraplegia 15 |
| 122462165 | ZIC3 | NM_003413.3(ZIC3): c.968C>T (p.Thr323Met) | CCACATCCGAGTGCACAYGGGCG | Heterotaxy, visceral, X-linked |
| 281875376 | ZMPSTE24 | NM_005857.4(ZMPSTE24): c.1349G>A (p.Trp450Ter) | CTGACTRGTTGTTCTCAATGTGG | Mandibuloacral dysplasia with type B lipodystrophy, not provided |
| 121908094 | ZMPSTE24 | NM_005857.4(ZMPSTE24): c.121C>T (p.Gln41Ter) | CCTTCCTAGCACAGCGGYAGGTG | Mandibuloacral dysplasia with type B lipodystrophy, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397515460 | ZMYND10 | NM_015896.3(ZMYND10): c.967C>T (p.Gln323Ter) | CCCTAACTGAAACCYAGCCTCCT | Ciliary dyskinesia, primary, 22 |
| 672601340 | ZMYND11 | NM_006624.5(ZMYND11): c.976C>T | CCTTCTGAAAACATTYAAGATAT | Mental retardation, autosomal dominant 30 |
| 397514642 | ZNF335 | NM_022095.3(ZNF335): c.3332G>A (p.Arg1111His) | GCAGCRGTGAGGCCAGATACTGG | Primary autosomal recessive microcephaly 10 |
| 781192528 | ZNF408 | NM_024741.2(ZNF408): c.1621C>T (p.Arg541Cys) | CCAGCTGCCTGAACTGCGGYGCC | RETINITIS PIGMENTOSA 72 |
| 373273223 | ZNF408 | NM_024741.2(ZNF408): c.1363C>T (p.His455Tyr) | CCGGCCCTCCCTGCGGCTGYATC, CCCTCCCTGCGGCTGYATCGCAA, CCTCCCTGCGGCTGYATCGCAAG | Exudative vitreoretinopathy 6 |
| 273585629 | ZNF469 | NM_001127464.2(ZNF469): c.11101G>A (p.Gly3701Ser) | AAACCCRGCCCCAGCTCCCAGGG, CAAACCCRGCCCCAGCTCCCAGG | Keratoconus 1 |
| 387907062 | ZNF469 | NM_001127464.2 (ZNF469):c.10016G>A (p.Cys3339Tyr) | CCTGTRCCCCCGGTGCCCCCGGG, ACCTGTRCCCCCGGTGCCCCCGG | Corneal fragility keratoglobus, blue sclerae AND joint hypermobility |
| 273585617 | ZNF469 | NM_001127464.2(ZNF469): c.290C>T (p.Pro97Leu) | CCCCCAGACCCCACYGGGGAGAA | Keratoconus 1 |
| 273585630 | ZNF469 | NM_001127464.2(ZNF469): c.11615C>T (p.Pro3872Leu) | CCTTCCCCCAGGGGAGACYCCTG, CCCCCAGGGGAGACYCCTGCTCA | Keratoconus 1 |

In some embodiments, a fusion protein recognizes canonical PAMs and therefore can correct the pathogenic G to A or C to T mutations with canonical PAMs, e.g., NGG, respectively, in the flanking sequences. For example, Cas9 proteins that recognize canonical PAMs comprise an amino acid sequence that is at least 80%, 85%, 90%, 95%, 97%, 98%, or 99% identical to the amino acid sequence of *Streptococcus pyogenes* Cas9 as provided by SEQ ID NO: 52, or to a fragment thereof comprising the RuvC and HNH domains of SEQ ID NO: 52.

It will be apparent to those of skill in the art that in order to target any of the fusion proteins comprising a Cas9 domain and an adenosine deaminase, as disclosed herein, to a target site, e.g., a site comprising a point mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. In some embodiments, the guide RNA comprises a structure 5'-[guide sequence]-guuuuagagcuagaaauagcaaguuaaaauaaggcuaguccguuaucaacuugaaaaaguggcaccgagucggugcuu uuu-3' (SEQ ID NO: 389), wherein the guide sequence comprises a sequence that is complementary to the target sequence. In some embodiments, the guide sequence comprises any of the nucleotide sequences provided in Table 2 The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein. Additional guide sequences are shown below in Table 3, including their locus.

TABLE 3

Additional target sites.

| locus | 5 to 3' |
|---|---|
| other sites within HEK2 locus | GAACACAAAGCATAGACTGC (SEQ ID NO: 390) |
| other sites within HEK2 locus | GGAACACAAAGCATAGACTG (SEQ ID NO: 391) |
| other sites within HEK2 locus | AACACAAAGCATAGACTGCG (SEQ ID NO: 392) |
| other sites within HEK2 locus | ACAAAGCATAGACTGCGGGG (SEQ ID NO: 393) |
| other sites within HEK2 locus | CAAAGCATAGACTGCGGGGC (SEQ ID NO: 394) |
| other sites within HEK2 locus | GTGGTAATTTTCCAGCCCGC (SEQ ID NO: 395) |
| other sites within HEK2 locus | CCTTTACAGGGCCAGCGGGC (SEQ ID NO: 396) |
| other sites within HEK2 locus | CTGTCACAGTTAGCTCAGCC (SEQ ID NO: 397) |
| other sites within HEK2 locus | GTGTTCCAGTTTCCTTTACA (SEQ ID NO: 398) |
| Hek-2 guideSEQ off-target | GAACACAATGCATAGATTGC (SEQ ID NO: 399) |
| Hek-2 similar site | GAAAAAAAGCAGAGACTGC (SEQ ID NO: 400) |
| Hek-2 similar site | GAATACTAAGCATAGACTCC (SEQ ID NO: 401) |
| Hek-2 similar site | GTAAACAAAGCATAGACTGA (SEQ ID NO: 402) |

TABLE 3-continued

Additional target sites.

| locus | 5 to 3' |
|---|---|
| Hek-2 similar site | GGACACAAAGCTTAGACTCC (SEQ ID NO: 403) |
| Hek-2 similar site | CAATACAAAGGATAGACTGC (SEQ ID NO: 404) |
| Hek-2 similar site | GAAGACCAAGGATAGACTGC (SEQ ID NO: 405) |
| Hek-2 similar site | GAAAACAAATCATTGACTGC (SEQ ID NO: 406) |
| Hek-2 similar site | GATCACAAAGCATGGACTGA (SEQ ID NO: 407) |
| Hek-2 similar site | GAAAACAAAACATAGAGTGC (SEQ ID NO: 408) |
| Hek-2 similar site | GAACATAAAGAATAGAATGA (SEQ ID NO: 409) |
| EMX1 | GAGTCCGAGCAGAAGAAGAA (SEQ ID NO: 410) |
| FANCF: | GGAATCCCTTCTGCAGCACC (SEQ ID NO: 411) |
| HEK293 site 2: | GAACACAAAGCATAGACTGC (SEQ ID NO: 412) |
| HEK293 site 3: | GGCCCAGACTGAGCACGTGA (SEQ ID NO: 413) |
| HEK293 site 4: | GGCACTGCGGCTGGAGGTCC (SEQ ID NO: 414) |
| RNF2 | GTCATCTTAGTCATTACCTG (SEQ ID NO: 415) |

Base Editor Efficiency

Some aspects of the disclosure are based on the recognition that any of the base editors provided herein are capable of modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate or deaminate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., point mutations or deaminations) versus indels. In some embodiments, the base editors provided herein are capable of generating a ratio of intended point mutations to indels that is greater than 1:1. In some embodiments, the base editors provided herein are capable of generating a ratio of intended point mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method, for example the methods used in the below Examples. in some embodiments, to calculate indel frequencies, sequencing reads are scanned for exact matches to two 10-bp sequences that flank both sides of a window in which indels might occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, an number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation, such as a point mutation, in a nucleic acid (e.g. a nucleic acid within a genome of a subject) without generating a significant number of unintended mutations, such as unintended point mutations. In some embodiments, a intended mutation is a mutation that is generated by a specific base editor bound to a gRNA, specifically designed to generate the intended mutation. In some embodiments, the intended mutation is a mutation associated with a disease or disorder. In some embodiments, the intended mutation is a adenine (A) to guanine (G) point mutation associated with a disease or disorder. In some embodiments, the intended mutation is a thymine (T) to cytosine (C) point mutation associated with a disease or disorder. In some embodiments, the intended mutation is a adenine (A) to guanine (G) point mutation within the coding region of a gene. In some embodiments, the intended mutation is a thymine (T) to cytosine (C) point mutation within the coding region of a gene. In some embodiments, the intended mutation is a point mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor). In some embodiments, any of the base editors provided herein are capable of generating a ratio of intended mutations to unintended mutations (e.g., intended point mutations:unintended point mutations) that is greater than 1:1. In some embodiments, any of the base editors provided herein are capable of generating a ratio of intended mutations to unintended mutations (e.g., intended point mutations:unintended point mutations) that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described in the "Base Editor Efficiency" section, herein, may be applied to any of the fusion proteins, or methods of using the fusion proteins provided herein.

Methods for Editing Nucleic Acids

Some aspects of the disclosure provide methods for editing a nucleic acid. In some embodiments, the method is a method for editing a nucleobase of a nucleic acid (e.g., a base pair of a double-stranded DNA sequence). In some embodiments, the method comprises the steps of: a) contacting a target region of a nucleic acid (e.g., a double-stranded DNA sequence) with a complex comprising a base editor (e.g., a Cas9 domain fused to an adenosine deaminase) and a guide nucleic acid (e.g., gRNA), wherein the target region comprises a targeted nucleobase pair, b) inducing strand separation of said target region, c) converting a first nucleobase of said target nucleobase pair in a single strand of the target region to a second nucleobase, and d) cutting no more than one strand of said target region, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the first nucleobase is an adenine. In some embodiments, the second nucleobase is a deaminated adenine, or inosine. In some embodiments, the third nucleobase is a thymine. In some embodiments, the fourth nucleobase is a cytosine. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., A:T to G:C). In some embodiments, the fifth nucleobase is a guanine. In some embodiments, at least 5% of the intended base pairs are edited. In some embodiments, at least 10%, 15%, 20%, 25%, 30%, 35%, 40%, 45%, or 50% of the intended base pairs are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine. In some embodiments, the first base is adenine. In some embodiments, the second base is not a G, C, A, or T. In some embodiments, the second base is inosine. In some embodiments, the base editor inhibits base excision repair of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein. In some embodiments, a target window is a deamination window.

In some embodiments, the disclosure provides methods for editing a nucleotide. In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the first base is adenine. In some embodiments, the second nucleobase is not G, C, A, or T. In some embodiments, the second base is inosine. In some embodiments, the base editor inhibits base excision repair of the edited strand. In some embodiments, the base editor protects (e.g., form base excision repair) or binds the non-edited strand. In some embodiments, the nucleobase editor comprises UGI activity. In some embodiments, the base editor comprises a catalytically inactive inosine-specific nuclease. In some embodiments, the nucleobase editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Pharmaceutical Compositions

Other aspects of the present disclosure relate to pharmaceutical compositions comprising any of the adenosine deaminases, fusion proteins, or the fusion protein-gRNA complexes described herein. The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g. for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump may be used (see, e.g., Langer, 1990, Science 249:1527-1533; Sefton, 1989, CRC Crit. Ref. Biomed. Eng. 14:201; Buchwald et al., 1980, Surgery 88:507; Saudek et al., 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228:190; During et al., 1989, Ann. Neurol. 25:351; Howard et al., 1989, J. Neurosurg. 71:105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic aqueous buffer. Where necessary, the pharmaceutical can also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration may be a liquid, e.g., sterile saline, lactated Ringer's or Hank's solution. In addition, the pharmaceutical composition can be in solid forms and re-dissolved or suspended immediately prior to use. Lyophilized forms are also contemplated.

The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., Gene Ther. 1999, 6:1438-47). Positively charged lipids such as N-[1-(2,3-dioleoyloxi)propyl]-N,N,N-trimethyl-amoniummethyl-sulfate, or "DOTAP," are particularly preferred for such particles and vesicles. The preparation of such lipid particles is well known. See, e.g., U.S. Pat. Nos. 4,880,635; 4,906, 477; 4,911,928; 4,917,951; 4,920,016; and 4,921,757; each of which is incorporated herein by reference.

The pharmaceutical composition described herein may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile water) for injection. The pharmaceutically acceptable diluent can be used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers may be formed from a variety of materials such as glass or plastic. In some embodiments, the container holds a composition that is effective for treating a disease described herein and may have a sterile access port. For example, the container may be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture may further comprise a second container comprising a pharmaceutically-acceptable buffer, such as phosphate-buffered saline, Ringer's solution, or dextrose solution. It may further include other materials desirable from a commercial and user standpoint, including other buffers, diluents, filters, needles, syringes, and package inserts with instructions for use.

Kits, Vectors, Cells

Some aspects of this disclosure provide kits comprising a nucleic acid construct comprising a nucleotide sequence encoding an adenosine deaminase capable of deaminating an adenosine in a deoxyribonucleic acid (DNA) molecule. In some embodiments, the nucleotide sequence encodes any of the adenosine deaminases provided herein. In some embodiments, the nucleotide sequence comprises a heterologous promoter that drives expression of the adenosine deaminase.

Some aspects of this disclosure provide kits comprising a nucleic acid construct, comprising (a) a nucleotide sequence encoding a napDNAbp (e.g., a Cas9 domain) fused to an adenosine deaminase, or a fusion protein comprising a napDNAbp (e.g., Cas9 domain) and an adenosine deaminase as provided herein; and (b) a heterologous promoter that drives expression of the sequence of (a). In some embodiments, the kit further comprises an expression construct encoding a guide nucleic acid backbone, (e.g., a guide RNA backbone), wherein the construct comprises a cloning site positioned to allow the cloning of a nucleic acid sequence identical or complementary to a target sequence into the guide nucleic acid (e.g., guide RNA backbone).

Some aspects of this disclosure provide cells comprising any of the adenosine deaminases, fusion proteins, or complexes provided herein. In some embodiments, the cells comprise a nucleotide that encodes any of the adenosine deaminases or fusion proteins provided herein. In some embodiments, the cells comprise any of the nucleotides or vectors provided herein.

The description of exemplary embodiments of the reporter systems above is provided for illustration purposes only and not meant to be limiting. Additional reporter systems, e.g., variations of the exemplary systems described in detail above, are also embraced by this disclosure.

It should be appreciated however, that additional fusion proteins would be apparent to the skilled artisan based on the present disclosure and knowledge in the art.

The function and advantage of these and other embodiments of the present invention will be more fully understood from the Examples below. The following Examples are intended to illustrate the benefits of the present invention and to describe particular embodiments, but are not intended to exemplify the full scope of the invention. Accordingly, it will be understood that the Examples are not meant to limit the scope of the invention.

EXAMPLES

Data provided in the below examples describe engineering of base editors that are capable of catalyzing hydrolytic deamination of adenosine (forming inosine, which base pairs like guanine (G)) in the context of DNA. There are no known naturally occurring adenosine deaminases that act on DNA. Instead, known adenosine deaminases act on RNA (e.g., tRNA or mRNA). The first deoxyadenosine deaminases were evolved to accept DNA substrates and deaminate deoxyadenosine (dA) to deoxyinosine. As one example, evolution experiments were performed using the adenosine deaminase acting on tRNA (ADAT) from *Escherichia coli* (TadA, for tRNA adenosine deaminase A), to engineer adenosine deaminases that act on DNA. Briefly, ecTadA was covalently fused to a dCas9 domain, and libraries of this fusion were assembled containing mutations in the deaminase portion of the construct. In the evolution experiments described below, several mutations in ecTadA were found to improve the ability of ecTadA to deaminate adenosine in DNA.

Example 1—Evolution of Adenosine Base Editors (Evolution #1)

Evolution of adenosine base editors (ABEs) was achieved by creating librars of an ecTadA-XTEN-dead Cas9 construct (pNMG-104) via error-prone PCR, which was mutagenized in the ecTadA portion of the editor only. Selection of editors capable of catalyzing A to I deamination on DNA (A to G reversion) was selected for using an antibiotic selection platform. For the first round of evolution (Evolution #1), an adenosine base editor (ABE) library was co-expressed with a gRNA that targeted an active site mutation in a chloramphenicol acetyl-transferase gene, which requires an A to G reversion to restore acetyl-transferase activity and subsequent survival on chloramphenicol selection media. The selection plasmid is co-transformed into the S1030 host strain along with the ABE library. Evolution #1 was conducted and mutations D108N and A106V were idenitified as two mutations which enable A to G reversions on DNA. The D108N mutation more efficiently induced A to G reversions in DNA than A106V. Sequence alignment studies with *S. aureus* TadA revealed that residue D108 participates in H-bond contacts with the 2' OH of the ribose sugar in the wild-type, tRNA substrate. In DNA, this 3' OH is replaced with a 3' H.

Wild-Type Adenosine Deaminases and A to G Deaminases

Figure 1:
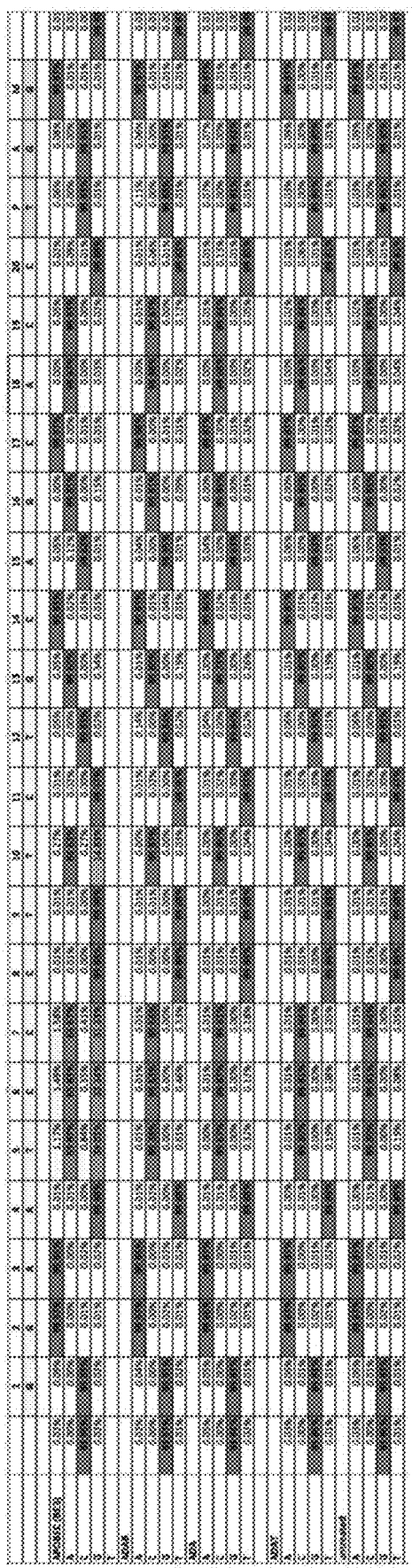
FIG. 1 shows high throughput screen results with various deaminases. APOBEC (BE3) is the positive control; ADAR acts on mRNA, ADA acts on deoxyadenosine, and ADAT acts on tRNA. The untreated group is the negative control. The sequence corresponds to SEQ ID: 45.

Transfection of various A to G deaminase fusions (+XTEN-nCas9) into Hek293T cells did not cause A to G SNP at the targeted sites. Six different sites were targeted, but none of the wild-type adenosine deaminase Cas9 fusions produced observable A to G modifications in DNA. BE3 (rAPOBEC1-XTEN-nCas9-UGI-NLS) was used as positive control. The following wild-type deaminase-nCas9 fusions were tested: ADAR (acts on mRNA), ADA (acts on deoxyadenosine), and ADAT (acts on tRNA) (FIG. 1).

Figure 2:
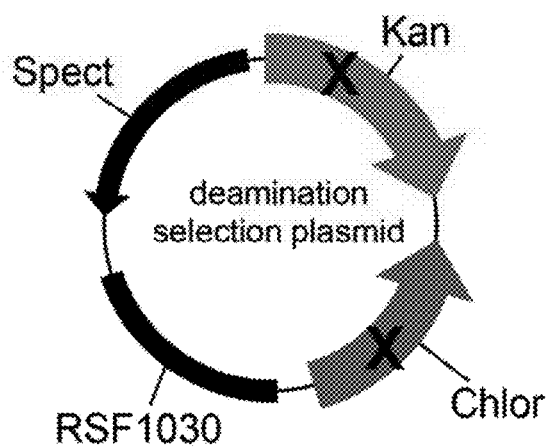
FIG. 2 is a schematic of a deamination selection plasmid.

A to G deaminases which act on DNA were developed. First, an antibiotic selection plasmid was developed, in which restoration of the active site residue in the antibiotic-resistant gene (A to G reversion) resulted in the host's resistance to antibiotic challenges. A high copy plasmid (RSF1030), was constructed. It required either a STOP reversion to a wild-type amino acid (Kan) or an active site residue restoration (Chlor). Specifically, on the template strand, the STOP needed to revert to glutamic acid (Kan) or tyrosine needed to revert to histidine (a cationic residue) (Chlor) (FIG. 2).

Figure 3:
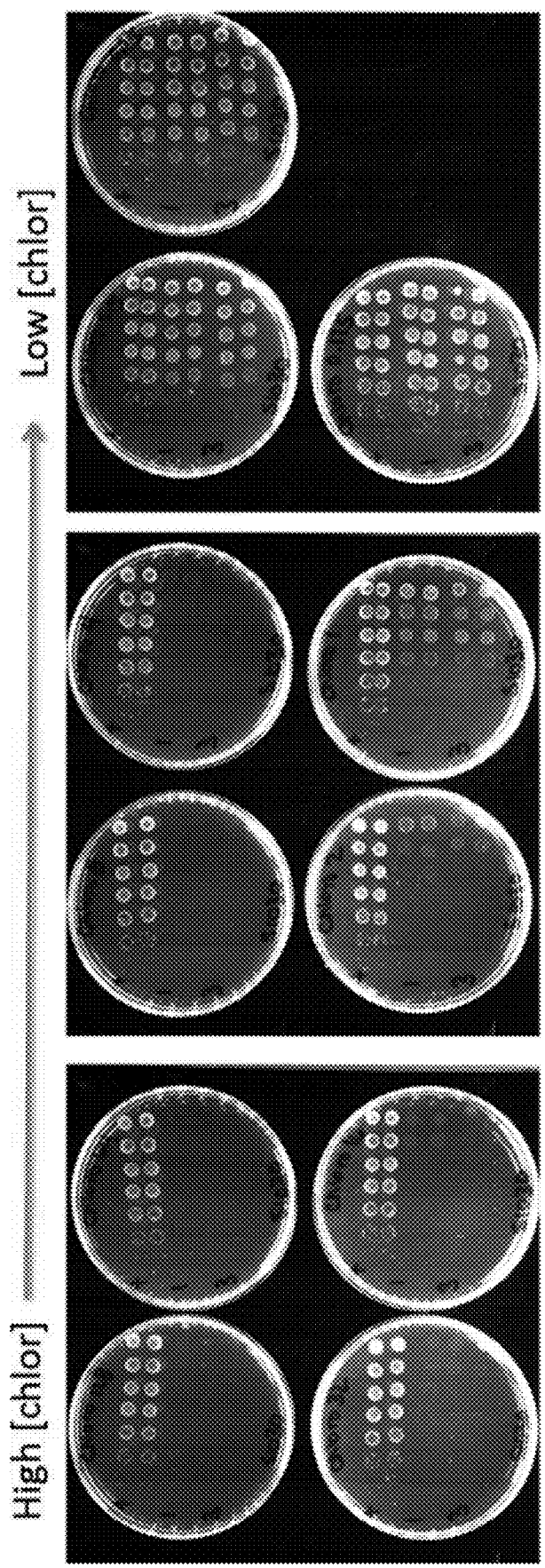
FIG. 3 shows a serial dilution of the selection plasmid in S1030 cells plated on increasing concentrations of chloramphenicol.

The minimum inhibitory concentration (MIC) was determined by the selection plasmid. The A to I selection plasmid was grown in S1030, and plated on varying concentrations of chloramphenicol. The MIC was found to be approximately 1 µg/mL. A serial dilution of the selection plasmid in S1030 cells (the host strain) plated on increasing concentrations of chlor (FIG. 3). Cells harboring library members which survive on concentrations of chlor above 1 µg/mL were considered to be possible hits.

Figure 4:
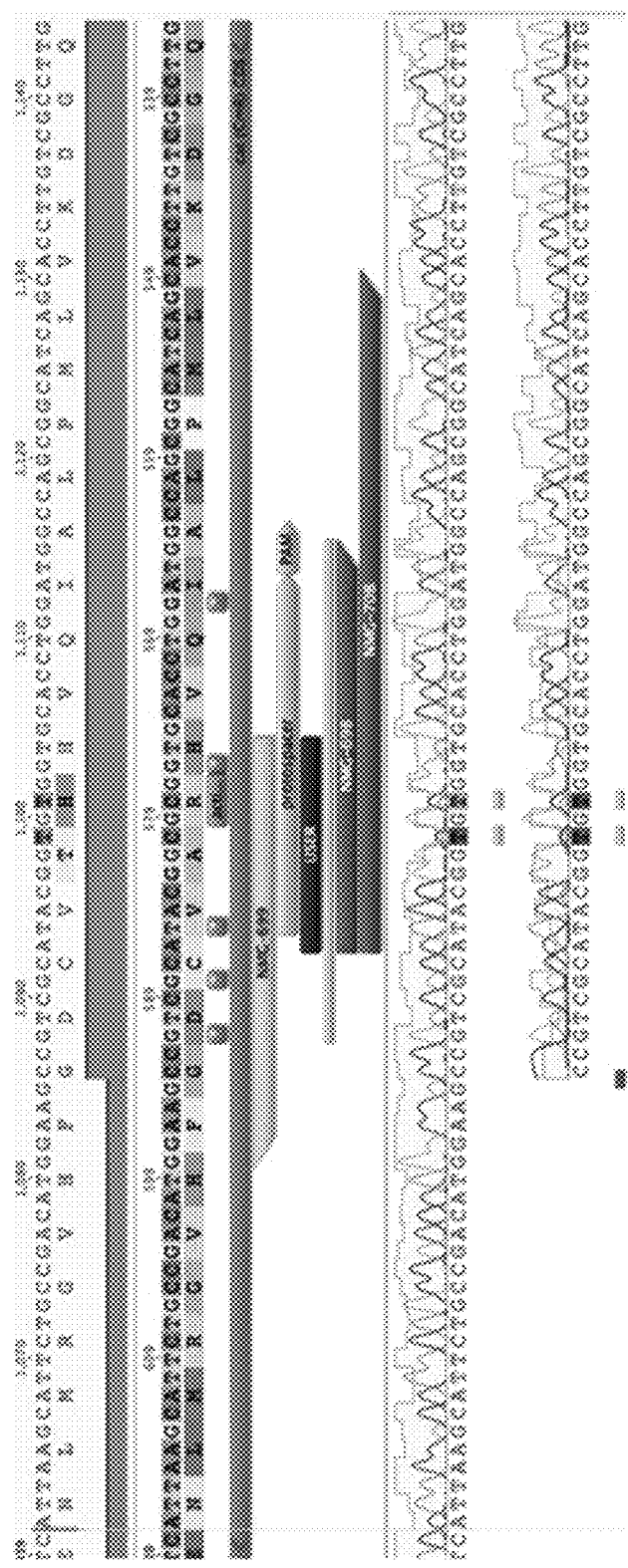
FIG. 4 shows the validation of chloramphenicol selection with a rAPOBEC1-XTEN-dCas9 construct as a positive control. The sequences from top to bottom correspond to SEQ ID NOs: 95 (the nucleotide sequence), 96 (the amino acid sequence), 97 (the nucleotide sequence), 98 (the amino acid sequence), 95 (the nucleotide sequence) and 99 (the truncated nucleotide sequence).

The chloramphenicol (Chlor) selection was further validated using rAPOBEC1-XTEN-dCas9 construct as a positive control. Colonies that survived at 8 µg/mL chlor were then sequenced, and the C to T reversion was observed in DNA (FIG. 4). The assay was performed by growing cells with the selection plasmid and deaminase fusion to $OD_{600\ nm}$~0.3 and then inducing fusion expression overnight. The resulting culture was then plated on increasing concentrations of chloramphenicol and the desired DNA reversion was screened.

An A to I deaminase library was then generated. Optimized assembly/library generation conditions, including PreCR vs. USER, electroporation vs. chemical composition, nucleofection vs. electroporation, outgrowth time, SOC vx. DRM, and sub-cloning vs. direct transformation, were examined. After the library assembly/electroporation conditions were optimized the following two libraries were made: APOBEC-XTEN-dCas9 and ADAT-XTEN-dCas9. The average library size was $2-4\times10^6$ based on the calculated colony-forming unit (CFU). The APOBEC-XTEN-dCas9 library produced no useful hits. The ADAT-XTEN-dCas9 library produced successful. The ADAT used was TadA (truncated) in *E. coli*.

Architecture of the Deaminase Library

Figure 5:
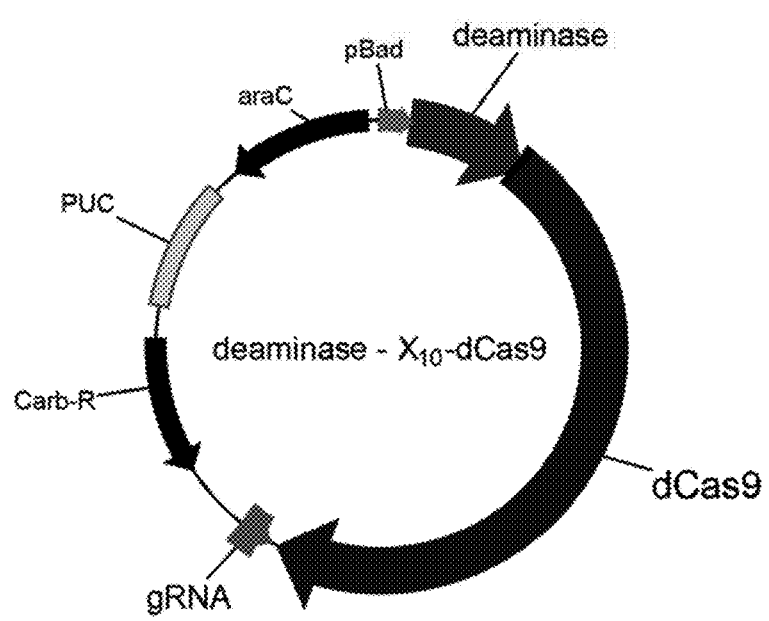
FIG. 5 is a schematic of a deaminase-XTEN-dCas9 construct.

The deaminase-XTEN-dCas9 fusion includes a SC101 backbone and a gRNA (lac promoter) to target the chloroamphernicol site (FIG. 5). Only deaminase is subjected to error-prone PCR, and the assembly is two-piece PreCR (a modified USER protocol). The gRNA is driven by the lac promoter; it targets the Chlor active site. A to G reversion is needed at position 9 of the protospacer to restore the His active site (a tyrosine to histidine reversion). Repair is needed and targeted on the template strand. APOBEC/CDA was used as a positive control. A to I constructs included the following: mADA, ADAR1, and ADAT2.

Figure 6:
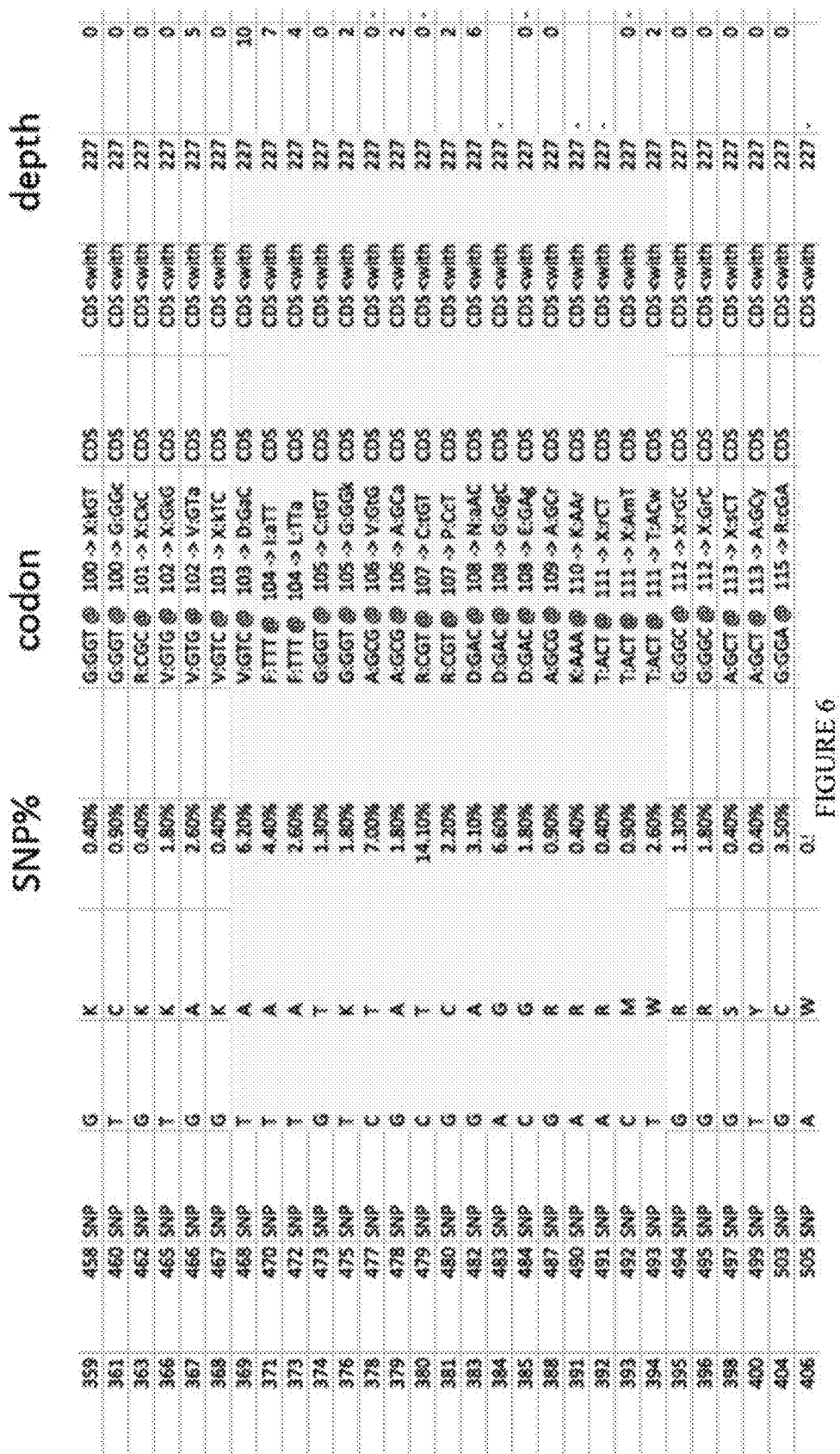
FIG. 6 shows the sequencing results from the first round of the TadA-XTEN-dCas9 library.
Figure 7:
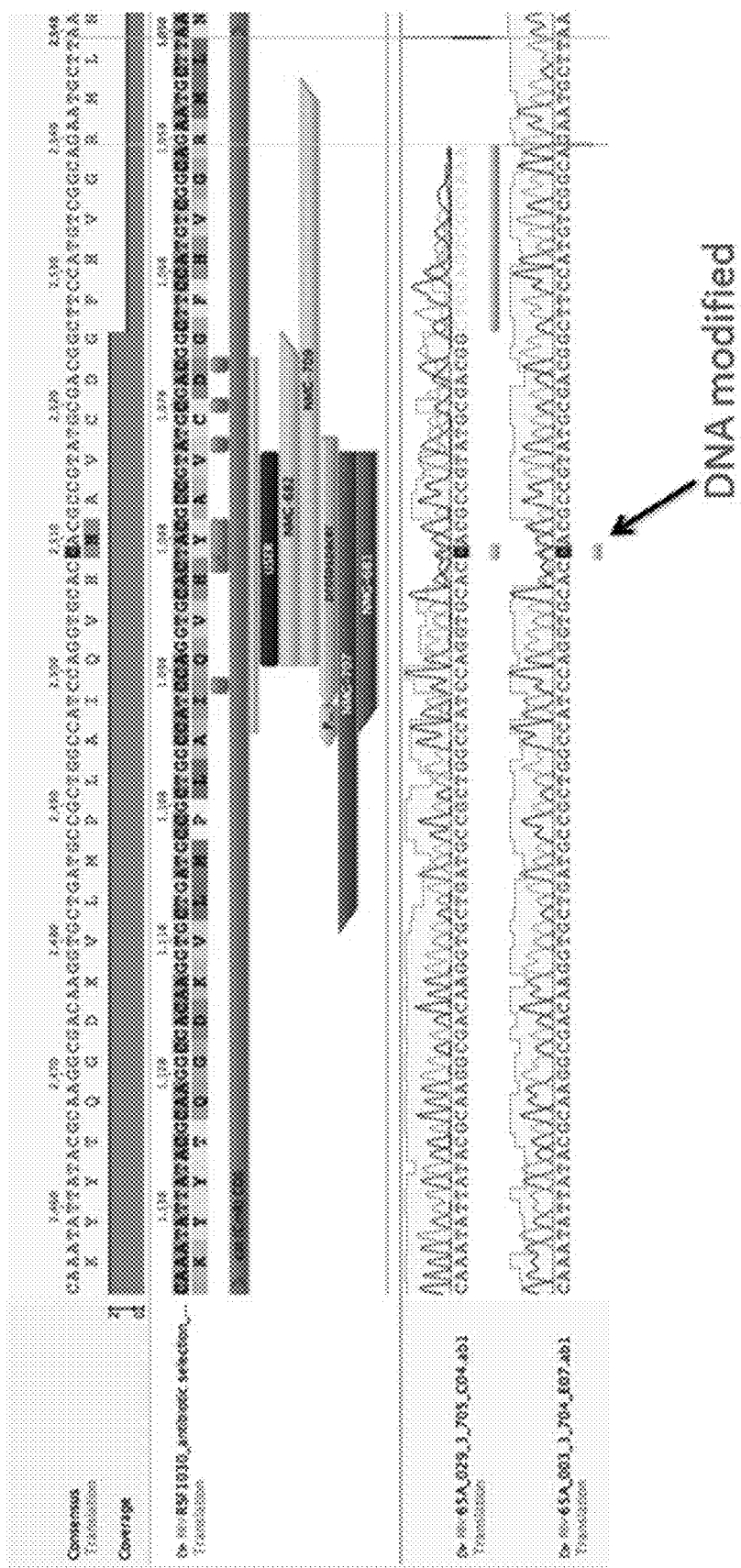
FIG. 7 shows the sequence of a selection plasmid; an A to G reversion was observed. The sequences from top to bottom correspond to SEQ ID NOs: 100 (the nucleotide sequence), 101 (the amino acid sequence), 102 (the nucleotide sequence), 103 (the amino acid sequence), 104 (the nucleotide sequence), and 100 (the nucleotide sequence).

A TadA-XTEN-dCas9 library was also constructed. Error Prone PCR on TadA enzyme only was used. The optimized protocol was used and resulting constructs were subcloned. S1030 cells (with the selection plasmid) were transformed with a TadA*-XTEN-dCas9 randomized library. Protein expression was induced after a recovery phase. The library was then plated the next day on increasing concentrations of chloramphenicol (0.5, 1, 2, and 4 µg/mL) onto separate 24×24 cm plates and incubated overnight. TadA(wt)-XTEN-dCas9 was used as a negative control. Colonies grew on all four places, and as concentrations increased, fewer colonies were observed. The negative control had far fewer colonies than the plates with library members. Eight selection plasmids were sequenced and all plasmids contained the A to G reversion at the targeted site. In all, 120 colonies were PCR-amplified and then sequenced. The results of the first round of sequencing are shown in FIG. 6. An exemplary sequence of a selection plasmid with the A to G reversion is given in FIG. 7. The target is the template strand's A to G (observed as T to C in coding). The example shows about 50% reversion in the Sanger trace (Y to H).

Figure 8:
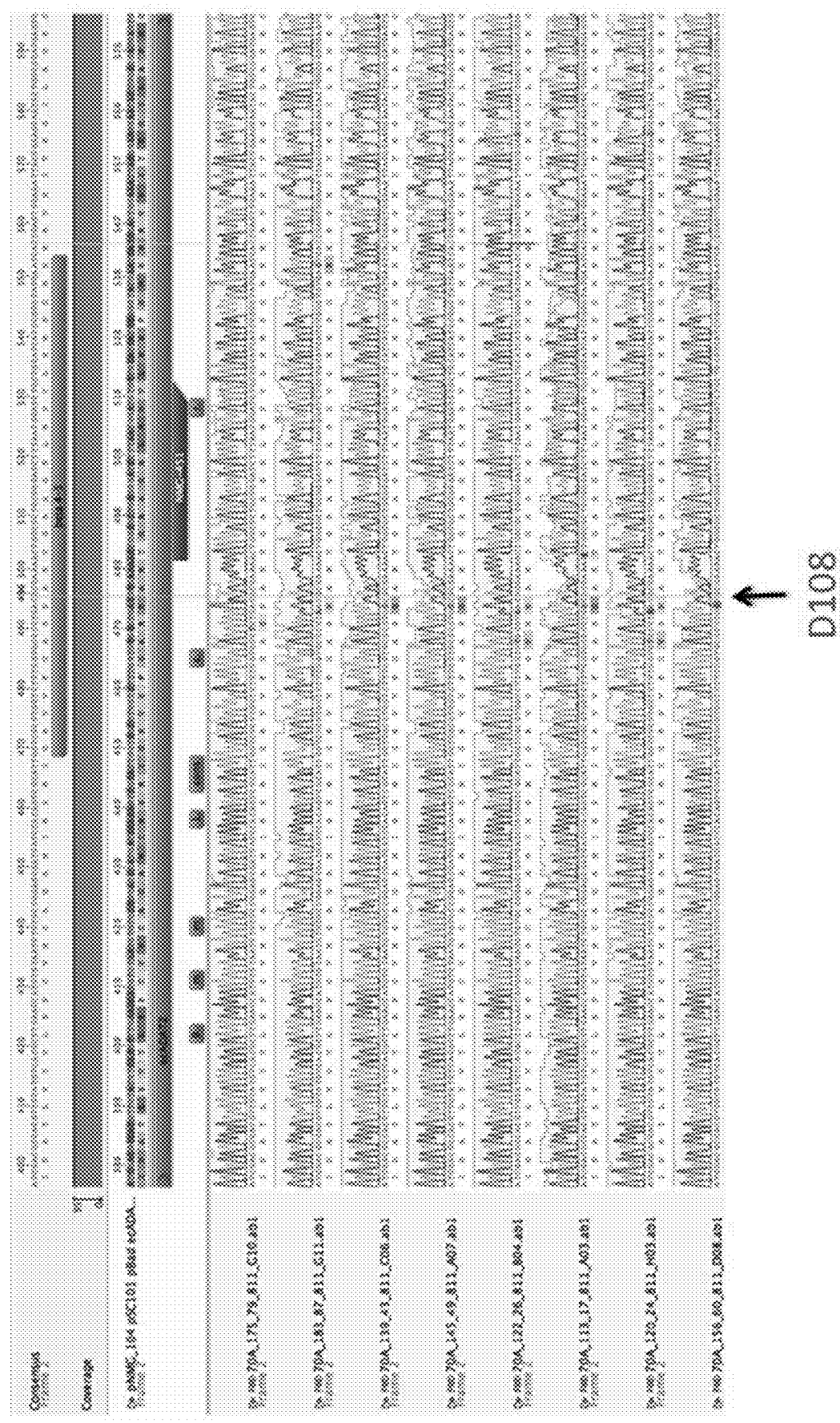
FIG. 8 shows the results of deaminase sequencing, illustrating the convergence at residue D108. The sequences correspond to SEQ ID NOs: 589-607 from top to bottom.
Figure 9:
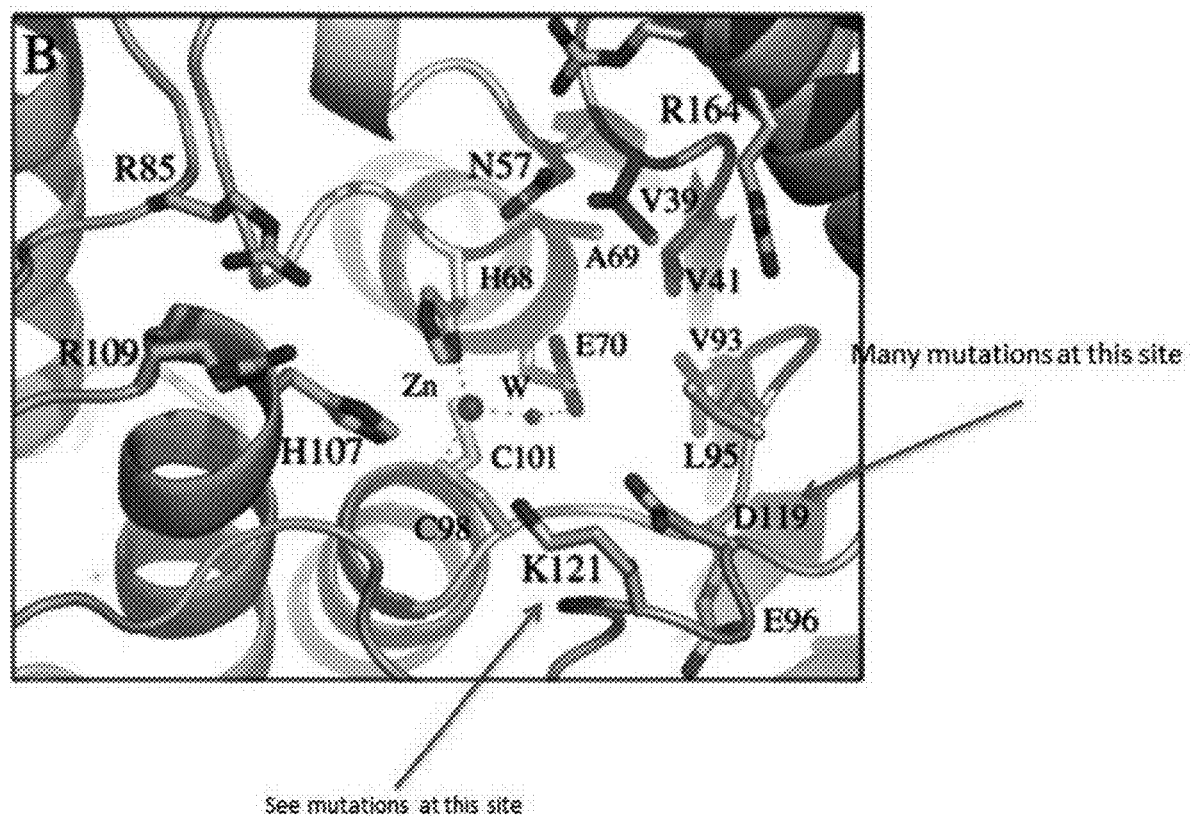
FIG. 9 shows the *E. coli* TadA crystal structure. Note that D119 in the figure corresponds to D108, as the residue numbering is offset in the figure.
Figure 10:
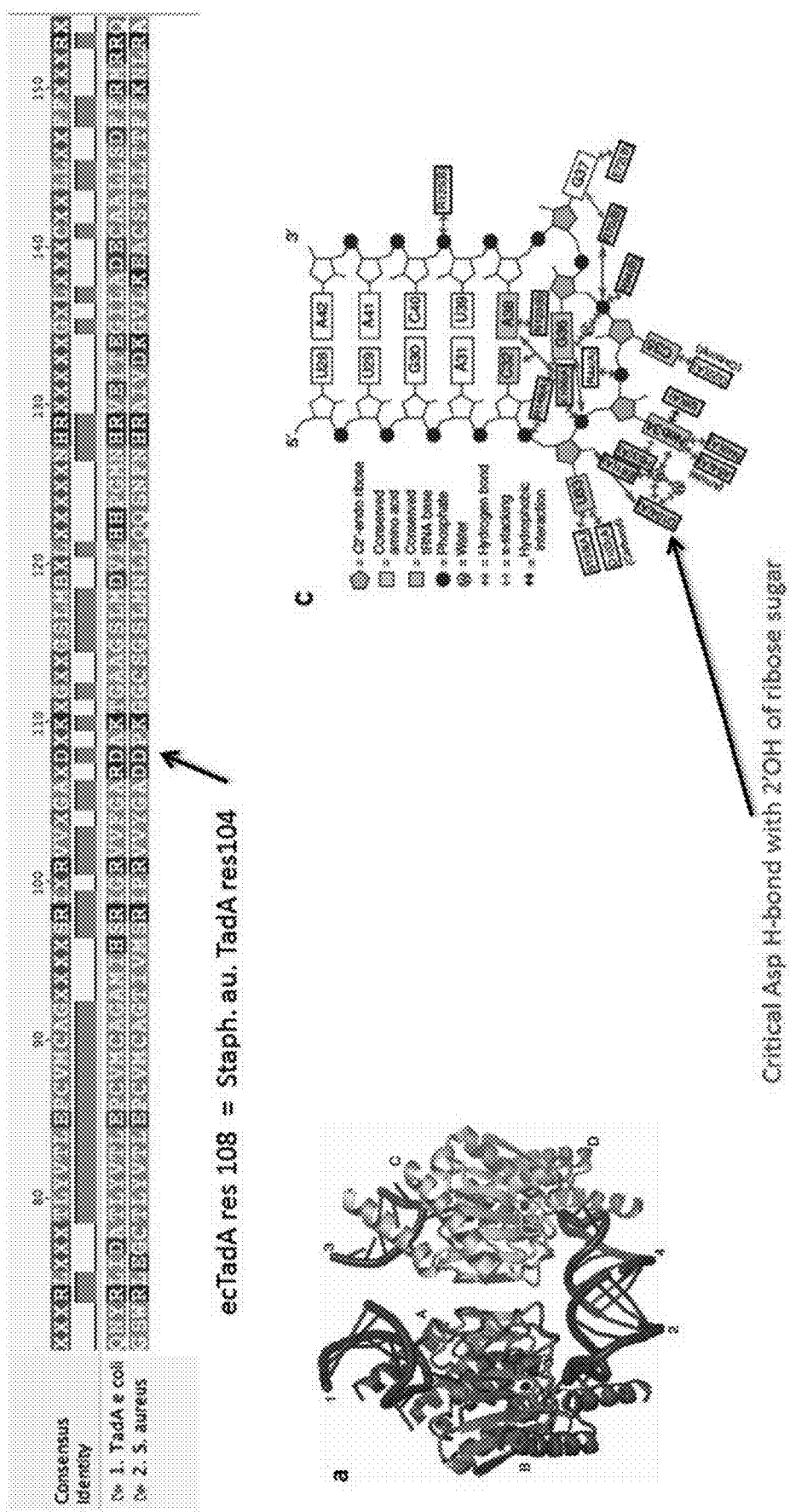
FIG. 10 shows the crystal structure of TadA (in *S. aureus*) tRNA and an alignment of with TadA from *E. coli*. The sequences from top to bottom correspond to SEQ ID NOs: 105-107.

A convergence at residue D108 was observed (FIG. 8). The crystal show of *E. coli* TadA is shown in FIG. 9. D119 in the figure is D108, as the residue numbers are offset. Many mutations were found to occur in that residue. FIG. 10 shows the crystal structure of Tad A (*S. aureus*) and aligns the sequences with that of *E. coli*. ecTadA residue 108 is equivalent to *S. aureus* TadA residue 104, which is part of a critical asparagine hydrogen bond with 2'OH of a ribose sugar.

Selection plasmids used in the evolution experiments contain mutations in various antibiotic resistance genes, which are targeted by adenosine base editors. Below are target sequences of the various antibiotic resistance genes (SEQ ID NOs: 441-444), where the targeted adenine required to restore resistance to its respective antibiotic is shown in bold and underlined. The plasmids used were high-copy plasmids with a RSF1030 origin.

Chloramphenicol target (H193Y): 5'-TACGGCGT AGTGCACCTGGA-3' (SEQ ID NO: 441)
Kanamycin target 1 (Q4Term): 5'-ATCTT ATTCGATCATGCGAA-3' (SEQ ID NO: 442)
Kanamycing target 2 (W15Term): 5'-GCTT AGGTGGAGCGCCTATT-3' (SEQ ID NO: 443)
Spectinomycin target (T89I): 5'-CAATG ATGACTTCTACAGCG-3' (SEQ ID NO: 444)

Mammalian codon optimized constructs were made by ordering a mammalian codon optimized version of ecTadA from Integrated Dna Technologies (IDT) as a gene block. This gene block was used to make pNMG-142, which served as a template for all subsequent mammalian codon-optimized constructs. See Table 4. After mutations were identified from the various rounds of evolution, primers were designed and ordered to introduce desired mutation(s) into the mammalian construct.

ecTadA Evolution and Challenge

Figure 11:
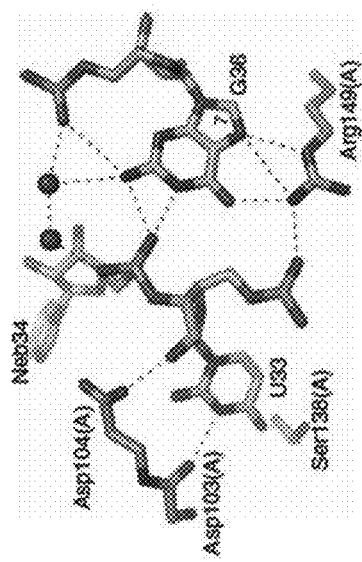
FIG. 11 shows results from the isolation and challenge of individual constructs from ecTadA evolution.

Individual constructs from the ecTadA evolution were isolated and challenged. Sixteen clones were sub-cloned, resulting in the first round of evolution. Each of the 16 clones were transformed in S1030 cells with selection plasmid and challenged with increasing doses of chloramphenicol. rAPOBEC1-XTEN-dCas9, which has a C to T reversion at the same site, was used as a control. The results are shown in FIGS. 11 and 12. FIG. 12 shows the C.F.U. of various constructs challenged on increasing concentrations of chloramphenicol. Constructs 3 and 4 performed the best under the assay's conditions. D108N is a key mutation.

Figure 19:
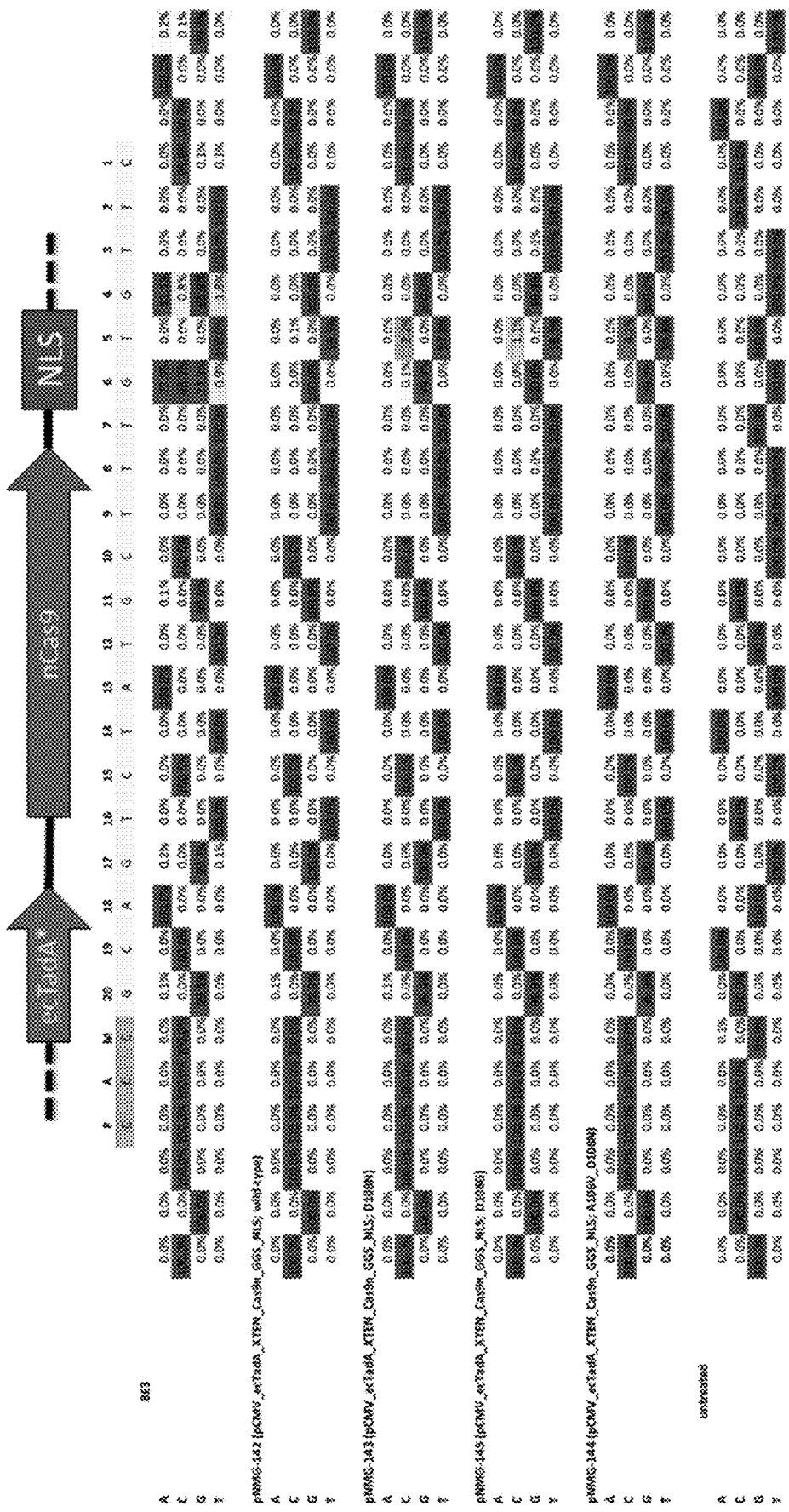
FIG. 19 shows the transfection of constructs into mammalian cells containing single or double mutations in ecTadA. The sequence corresponds to SEQ ID NO: 41.
Figure 20:
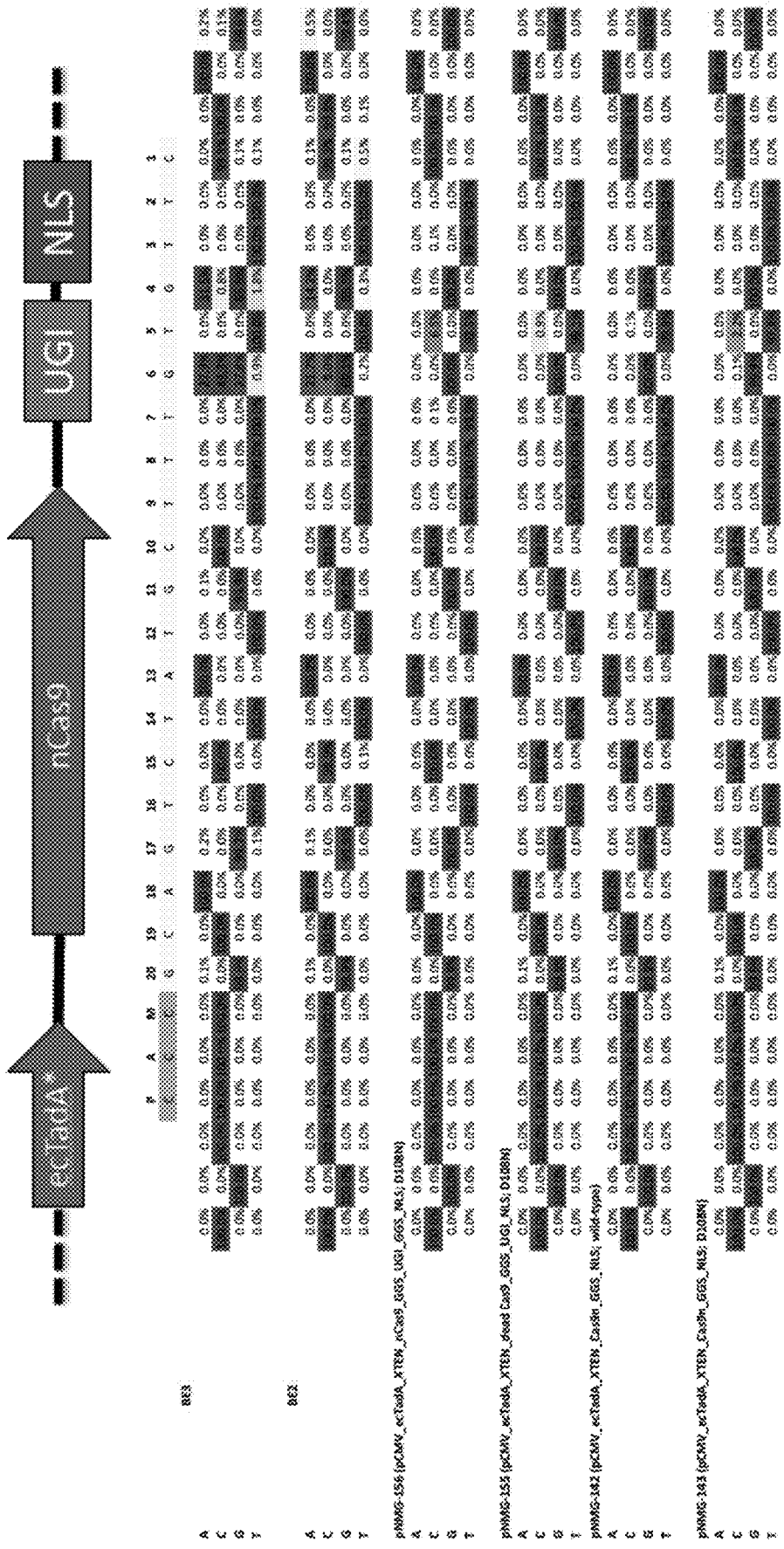
FIG. 20 shows the transfection of constructs with the addition of UGI to adenosine nucleobase editor (ABE) (D108N). The sequence corresponds to SEQ ID NO: 41.

Base editors, having mutations at residue D108 of ecTadA are capable of generating an adenine to guanine mutation in DNA via hydrolytic deamination of adenine, which results in inosine formation at the adenine site. Inosine is the read as guanine by DNA polymerase. See FIGS. 18-22, and 129-139, which show the ability of various base editors to generate an adenine to guanine mutation in DNA in various target DNA sequences, such as Hek2 (FIGS. 19, 20, and 129), Hek 2-1 (FIG. 130), Hek 2-2 (FIG. 131), Hek 2-3 (FIG. 132), Hek 2-4 (FIG. 133), Hek 2-6 (FIG. 134), Hek 2-9 (FIG. 135), Hek 2-10 (FIG. 136), RNF2 (FIG. 138), FANCF (FIG. 139), EMX1 (FIG. 21), and Hek3 (FIGS. 22 and 137). In these experiments the D108N mutation as most efficient for generating an A to G mutation, with the addition of an A106V mutation improving efficiency further. Additionally, base editors more efficiently generated A to G mutations at the Hek2 site than any other site tested. In the figures, BE3 and BE2 refer to base editors that induce C to G mutations and act as a positive control for C to G base editing.

Figure 13:
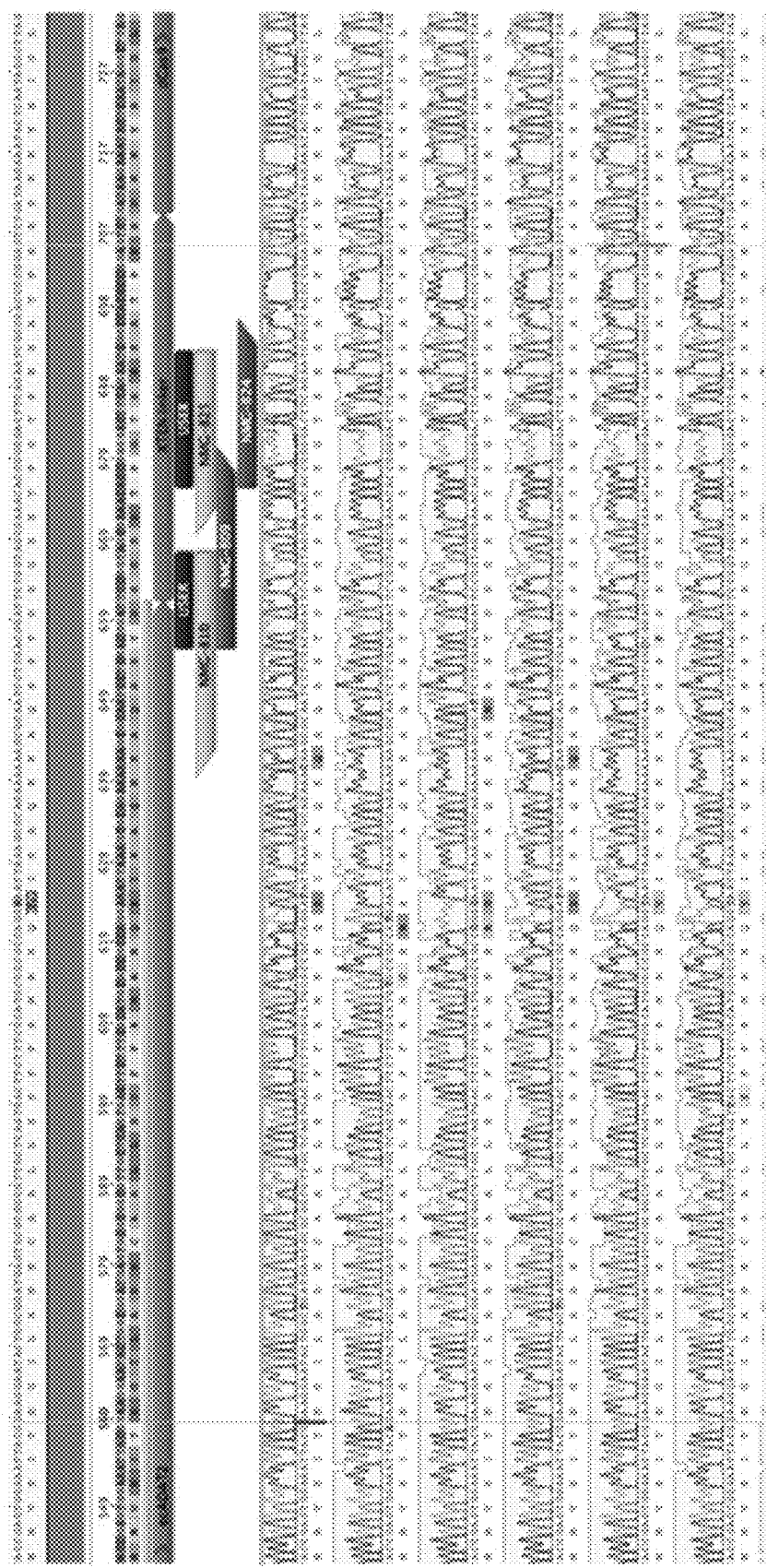
FIG. 13 shows data from the second round of evolution from the constructs containing the D108N mutation. The sequences from top to bottom correspond to SEQ ID NOs: 608-623.

A second round of evolution, described in greater detail below, was performed. Constructs containing the D108N mutation were randomized (plasmid NMG-128). The selection assay was repeated, and the clones were challenged with high concentrations of chloramphenicol. The resulting material was sub-cloned, and the selection assay was repeated. The resulting colonies that survived on high concentrations of chloramphenicol were then sequenced. An enrichment of mutations at position E155 was observed (FIG. 13).

A to G Editing in Mammalian Cells

Figure 14:
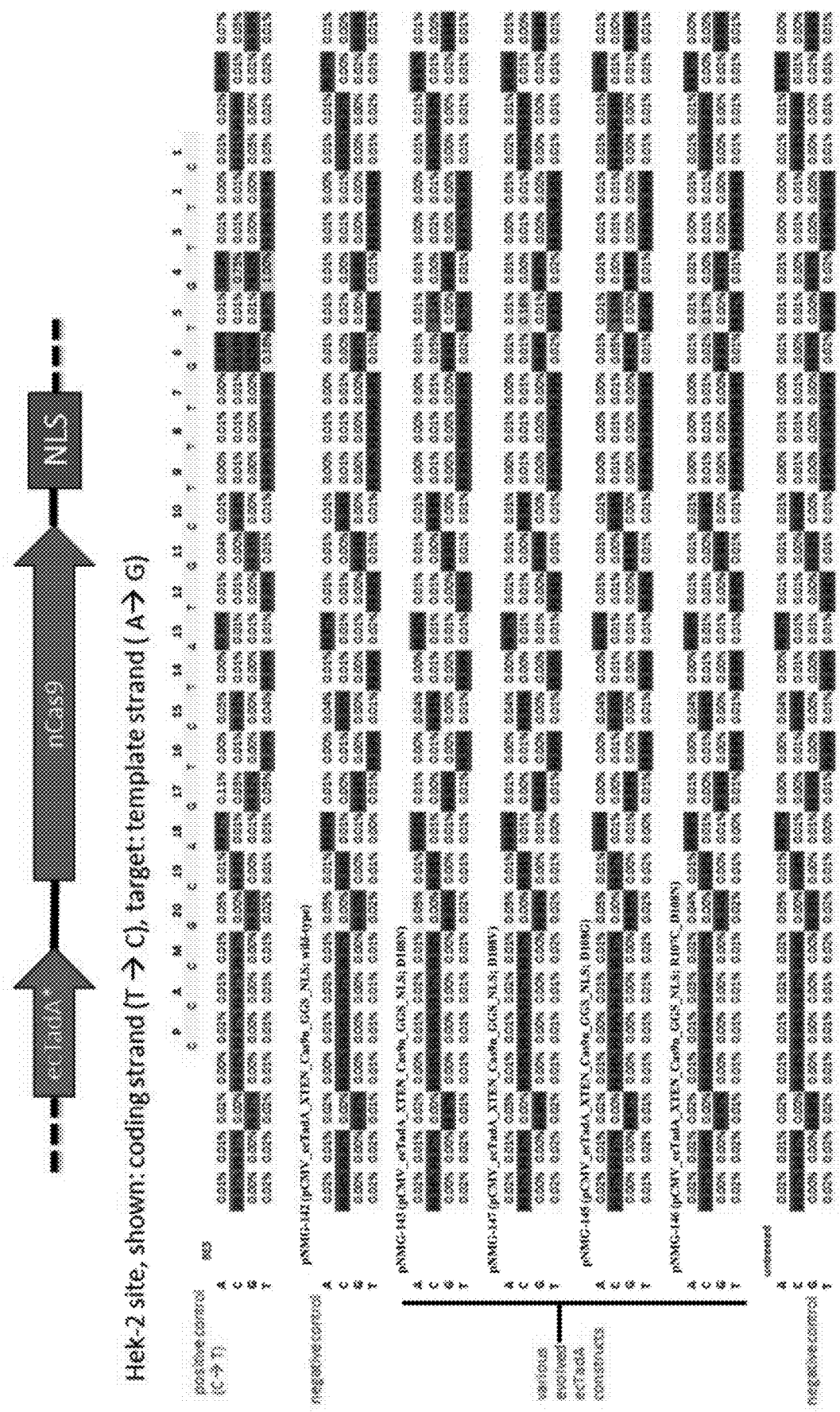
FIG. 14 shows A to G editing in mammalian cells. The sequence corresponds to SEQ ID NO: 41.

A to G editing in was examined in mammalian (Hek293T) cells. As shown in FIG. 14, the editing (from A to G) occurred in the various evolved ecTadA constructs, while it did not occur in the negative controls. The constructs used in the experiments described herein (e.g., Evolution #1-#7) are shown in Table 4. Table 4 includes the construct name, the construct architecture, and the ecTadA mutations. In table 4, pCMV refers to the expression vector comprising the construct. ecTadA refers to the ecTadA of SEQ ID NO: 1, however, for constructs comprising two ecTadA sequences, the second (C-terminal to the first ecTadA) ecTadA sequence does not comprise an N-terminal methionine. Table 4 also lists the mutations in ecTadA relative to SEQ ID NO: 1. Wild-type ecTadA refers to SEQ ID NO: 1. When two ecTadA domains are present the mutations in both ecTadA domains are indicated with the N-terminal ecTadA being indicated first. The 24 a.a linker refers to the amino acid sequence SGGSSGGSSGSETPGTSESATPES (SEQ ID NO: 685), the 32 a.a linker refers to the amino acid sequence SGGSSGGSSGSETPGTSESATPESSGGSSGGS (SEQ ID NO: 385), the 40 a.a linker refers to the amino acid sequence SGGSSGGSSGSETPGTSESATPESSGGSSGGSSGGSSGGS (SEQ ID NO: 686), the 64 a.a linker refers to the amino acid sequence SGGSSGGSSG-SETPGTSESATPESSGGSSGGSSGGSSGGSSGSETPGT-SESATPESSGGS SGGS (SEQ ID NO: 687), and the 92 a.a. linker refers to the amino acid sequence (SEQ ID NO: 688)
PGSPAGSPTSTEEGTSESATPESGPGTSTEPSEGSAPGSPAGSPT-
STEEGTST

EPSEGSAPGTSTEPSEGSAPGTSESATPESGPGSEPATS.

TABLE 4

Plasmid Identity Key

| Name | Construct Architecture | Mutations in TadA |
|---|---|---|
| pNMG-142 | pCMV_ecTadA_XTEN_Cas9n_SGGS_NLS | wild-type |
| pNMG-143 | pCMV_ecTadA_XTEN_Cas9n_SGGS_NLS | D108N |
| pNMG-144 | pCMV_ecTadA_XTEN_Cas9n_SGGS_NLS | A106V_D108N |
| pNMG-145 | pCMV_ecTadA_XTEN_Cas9n_SGGS_NLS | D108G |
| pNMG-146 | pCMV_ecTadA_XTEN_Cas9n_SGGS_NLS | R107C_D108N |
| pNMG-147 | pCMV_ecTadA_XTEN_Cas9n_SGGS_NLS | D108V |
| pNMG-155 | pCMV_ecTadA_XTEN_dead Cas9_SGGS_UGI_NLS | D108N |

TABLE 4-continued

Plasmid Identity Key

| Name | Construct Architecture | Mutations in TadA |
|---|---|---|
| pNMG-156 | pCMV_ecTadA_XTEN_nCas9_SGGS_UGI_SGGS_NLS | D108N |
| pNMG-157 | pCMV_ecTadA_XTEN_dead Cas9_SGGS_UGI_SGGS_NLS | D108G |
| pNMG-158 | pCMV_ecTadA_XTEN_nCas9_SGGS_UGI_SGGS_NLS | D108G |
| pNMG-160 | pCMV_ecTadA_XTEN_nCas9_SGGS_AAG*(E125Q)_SGGS_NLS | D108N |
| pNMG-161 | pCMV_ecTadA_XTEN_Cas9n_SGGS_EndoV*(D35A)_NLS | D108N |
| pNMG-162 | pCMV_ecTadA_XTEN_Cas9n_SGGS_NLS | H8Y_D108N_S127S_D147Y_Q154H |
| pNMG-163 | pCMV_ecTadA_XTEN_Cas9n_SGGS_NLS | H8Y_R24W_D108N_N127S_D147Y_E155V |
| pNMG-164 | pCMV_ecTadA_XTEN_Cas9n_SGGS_NLS | D108N_D147Y_E155V |
| pNMG-165 | pCMV_ecTadA_XTEN_Cas9n_SGGS_NLS | H8Y_D108N_S127S |
| pNMG-171 | pCMV_Cas9n_XTEN_ecTadA_SGGS_NLS | wild-type |
| pNMG-172 | pCMV_Cas9n_XTEN_ecTadA_SGGS_NLS | D108N |
| pNMG-173 | pCMV_Cas9n_XTEN_ecTadA_SGGS_NLS | H8Y_D108N_N127S_D147Y_Q154H |
| pNMG-174 | pCMV_Cas9n_XTEN_ecTadA_SGGS_NLS | H8Y_R24W_D108N_N127S_D147Y_E155V |
| pNMG-175 | pCMV_Cas9n_XTEN_ecTadA_SGGS_NLS | D108N_D147Y_E155V |
| pNMG-176 | pCMV_Cas9n_XTEN_ecTadA_SGGS_NLS | H8Y_D108N_S127S |
| pNMG-177 | pCMV_ecTadA_XTEN_Cas9n_SGGS_NLS | A106V_D108N_D147Y_E155V |
| pNMG-178 | pCMV_ecTadA_XTEN_Cas9n_SGGS_UGI_SGGS_NLS | D108N_D147Y_E155V |
| pNMG-179 | pCMV_ecTadA_XTEN_Cas9n_SGGS_AAG*(E125Q)_SGGS_NLS | A106V_D108N_D147Y_E155V |
| pNMG-180 | pCMV_ecTadA_XTEN_Cas9n_SGGS_UGI_SGGS_NLS | A106V_D108N_D147Y_E155V |
| pNMG-181 | pCMV_ecTadA_XTEN_Cas9n_SGGS_AAG*(E125Q)_SGGS_NLS | D108N_D147Y_E155V |
| pNMG-182 | pCMV_ecTadA_SGGS_nCas9_SGGS_NLS | D108N_D147Y_E155V |
| pNMG-183 | pCMV_ecTadk(SGGS)2-XTEN-(SGGS)2_nCas9_SGGS_NLS | D108N_D147Y_E155V |
| pNMG-235 | pCMV_ecTadA_XTEN_Cas9n_XTEN_AAG*(E125A)_SGGS_NLS | A106V_D108N_D147Y_E155V |
| pNMG-236 | pCMV_ecTadA_XTEN_Cas9n_XTEN_AAG*(E125Q)_SGGS_NLS | A106V_D108N_D147Y_E155V |
| pNMG-237 | pCMV_ecTadA_XTEN_Cas9n_XTEN_AAG*(wt)_SGGS_NLS | A106V_D108N_D147Y_E155V |
| pNMG-238 | pCMV_AAG*(E125A)_XTEN_ecTadA_XTEN_Cas9n_SGGS_NLS | A106V_D108N_D147Y_E155V |
| pNMG-239 | pCMV_AAG*(wt)_XTEN_ecTadA_XTEN_Cas9n_SGGS_NLS | A106V_D108N_D147Y_E155V |
| pNMG-240 | pCMV_ecTadA_XTEN_Cas9n_XTEN_EndoV*(D35A)_SGGS_NLS | A106V_D108N_D147Y_E155V |
| pNMG-241 | pCMV_ecTadA_XTEN_Cas9n_XTEN_EndoV*(wt)_SGGS_NLS | A106V_D108N_D147Y_E155V |

TABLE 4-continued

Plasmid Identity Key

| Name | Construct Architecture | Mutations in TadA |
|---|---|---|
| pNMG-242 | pCMV_EndoV*(D35A)_XTEN_ecTadA_XTEN_Cas9n_SGGS_NLS | A106V_D108N_D147Y_E155V |
| pNMG-243 | pCMV_EndoV*(wt)_XTEN_ecTadA_XTEN_Cas9n_SGGS_NLS | A106V_D108N_D147Y_E155V |
| pNMG-247 | pCMV_ecTadA_XTEN_Cas9 (wild-type)_SGGS_NLS | wild-type |
| pNMG-248 | pCMV_ecTadA_XTEN_Cas9 (wild-type)_SGGS_NLS | D108N_D147Y_E155V |
| pNMG-249 | pCMV_ecTadA_XTEN_Cas9 (wild-type)_SGGS_NLS | A106V_D108N_D147Y_E155V |
| pNMG-250 | pCMV_ecTadA_XTEN_Cas9 (wild-type)_SGGS_UGI_SGGS_NLS | D108N_D147Y_E155V |
| pNMG-251 | pCMV_ecTadA_XTEN_Cas9 (wild-type)_SGGS_AAG*(E125Q)_SGGS_NLS | A106V_D108N_D147Y_E155V |
| pNMG-274 | pCMV_ecTadA_SGGS_NLS (no Cas9 fusion) | wild-type |
| pNMG-275 | pCMV_ecTadA_SGGS_NLS (no Cas9 fusion) | A106V_D108N_D147Y_E155V |
| pNMG-276 | pCMV_ecTadA-(SGGS)2-XTEN-(SGGS)2_ecTadA_XTEN_nCas9_SGGS_NLS | (wild-type) + (wild-type) |
| pNMG-277 | pCMV_ecTadA-(SGGS)2-XTEN-(SGGS)2_ecTadA_XTEN_nCas9_SGGS_NLS | (A106V_D108N_D147Y_E155V) + (A106V_D108N_D147Y_E155V) |
| pNMG-278 | pCMV_ecTadA_XTEN_nCas9_SGGS_NLS | D108Q_D147Y_E155V |
| pNMG-279 | pCMV_ecTadA_XTEN_nCas9_SGGS_NLS | D108M_D147Y_E155V |
| pNMG-280 | pCMV_ecTadA_XTEN_nCas9_SGGS_NLS | D108L_D147Y_E155V |
| pNMG-281 | pCMV_ecTadA_XTEN_nCas9_SGGS_NLS | D108K_D147Y_E155V |
| pNMG-282 | pCMV_ecTadA_XTEN_nCas9_SGGS_NLS | D108I_D147Y_E155V |
| pNMG-283 | pCMV_ecTadA_XTEN_nCas9_SGGS_NLS | D108F_D147Y_E155V |
| pNMG-284 | pCMV_ecTadA_LONGER LINKER (92 a.a.)_ecTadA_XTEN_nCas9_SGGS_NLS | (wild-type) + (A106V_D108N_D147Y_E155V) |
| pNMG-285 | pCMV_ecTadA_LONGER LINKER (92 a.a.)_ecTadA_XTEN_nCas9_SGGS_NLS | (A106V_D108N_D147Y_E155V) + (A106V_D108N_D147Y) |
| pNMG-285b | pCMV_ecTadA_LONGER LINKER (92 a.a.)_ecTadA_XTEN_nCas9_SGGS_NLS | (A106V_D108N_D147Y_E155V) + (A106V_D108N_D147Y_E155V) |
| pNMG-286 | pCMV_ecTadA_XTEN_nCas9_SGGS_NLS | A106V_D108M_D147Y_E155V |
| pNMG-287 | pCMV_ecTadA-(SGGS)2-XTEN-(SGGS)2_ecTadA_XTEN-nCas9 (S. aureus)_SGGS_NLS | (A106V_D108N_D147Y_E155V) + (A106V_D108N_D147Y_E155V) |
| pNMG-289 | pCMV_ecTadA-(SGGS)2-XTEN-(SGGS)2_ecTadA_XTEN_nCas9_SGGS_UGI_NLS | (A106V_D108N_D147Y_E155V) + (A106V_D108N_D147Y_E155V) |
| pNMG-290 | pCMV_ecTadA-(SGGS)2-XTEN-(SGGS)2_ecTadA(SGGS)2-XTEN-(SGGS)2_nCas9_SGGS_UGI_NLS | (A106V_D108N_D147Y_E155V) + (A106V_D108N_D147Y_E155V) |
| pNMG-293 | pCMV_ecTadA_XTEN_Cas9n_SGGS_NLS | E59A_A106V_D108N_D147Y_E155V |
| pNMG-294 | pCMV_ecTadA_XTEN_Cas9n_SGGS_NLS | E59A |
| pNMG-295 | pCMV_ecTadA_SGGS_NLS (no Cas9 fusion) | E59A |
| pNMG-296 | pCMV_ecTadA_SGGS_NLS (no Cas9 fusion) | E59A cat dead_A106V_D108N_D147Y_E155V |
| pNMG-297 | pCMV_ecTadA-(SGGS)2-XTEN-(SGGS)2_ecTadA_XTEN_nCas9_SGGS_NLS | (A106V_D108N_D147Y_E155V) + (wild-type) |
| pNMG-298 | pCMV_ecTadA-(SGGS)2-XTEN-(SGGS)2_ecTadA_XTEN_nCas9_SGGS_NLS | (D108M_D147Y_E155V) + (D108M_D147Y_E155V) |

TABLE 4-continued

Plasmid Identity Key

| Name | Construct Architecture | Mutations in TadA |
|---|---|---|
| pNMG-320 | pCMV_ecTadA-(SGGS)2-XTEN-(SGGS)2_ecTadA_XTEN_nCas9_SGGS_NLS | (wild-type) + (A106V_D108N_D147Y_E155V) |
| pNMG-321 | pCMV_ecTadA-(SGGS)2-XTEN-(SGGS)2_ecTadA_XTEN_nCas9_SGGS_NLS | (E59A_A106V_D108N_D147Y_E155V) + (A106V_D108N_D147Y_E155V) |
| pNMG-322 | pCMV_ecTadA-(SGGS)2-XTEN-(SGGS)2_ecTadA_XTEN_nCas9_SGGS_NLS | (A106V_D108N_D147Y_E155V) + (E59A_A106V_D108N_D147Y_E155V) |
| pNMG-335 | pCMV_TadA3p-XTEN-TadA2p-XTEN-nCas9-NLS | wild-type |
| pNMG-336 | pCMV_ecTadk(SGGS)2-XTEN-(SGGS)2_nCas9_SGGS_UGI_SGGS_NLS | L84F_A106V_D108N_H123Y_D147Y_E155V_I156Y |
| pNMG-337 | pCMV_ecTadk(SGGS)2-XTEN-(SGGS)2_nCas9_SGGS_UGI_SGGS_NLS | A106V_D108N_D147Y_E155V |
| pNMG-338 | pCMV_ecTadk(SGGS)2-XTEN-(SGGS)2_nCas9_SGGS_UGI_SGGS_NLS | L84F_A106V_D108N_H123Y_D147Y_E155V_I156F |
| pNMG-339 | pCMV_ecTadA-(SGGS)2-XTEN-(SGGS)2_ecTadk(SGGS)2-XTEN-(SGGS)2_nCas9_SGGS_UGI_SGGS_NLS | (L84F_A106V_D108N_H123Y_D147Y_E155V_I156Y) + (L84F_A106V_D108N_H123Y_D147Y_E155V_I156Y) |
| pNMG-340 | pCMV_ecTadA-(SGGS)2-XTEN-(SGGS)2_ecTadk(SGGS)2-XTEN-(SGGS)2_nCas9_SGGS_UGI_SGGS_NLS | (A106V_D108N_D147Y_E155V) + (A106V_D108N_D147Y_E155V) |
| pNMG-341 | pCMV_ecTadA-(SGGS)2-XTEN-(SGGS)2_ecTadk(SGGS)2-XTEN-(SGGS)2_nCas9_SGGS_UGI_SGGS_NLS | (L84F_A106V_D108N_H123Y_D147Y_E155V_I156F) + (L84F_A106V_D108N_H123Y_D147Y_E155V_I156F) |
| pNMG-345 | pCMV_S. aureusTadA-(SGGS)2-XTEN-(SGGS)2-S. aureusTadA-(SGGS)2-XTEN-(SGGS)2-nCas9_SGGS_NLS | wild-type |
| pNMG-346 | pCMV_S. aureusTadA-(SGGS)2-XTEN-(SGGS)2-S. aureusTadA-(SGGS)2-XTEN-(SGGS)2-nCas9_SGGS_NLS | (D108N) + (D108N) |
| pNMG-347 | pCMV_S. aureusTadA-(SGGS)2-XTEN-(SGGS)2-S. aureusTadA-(SGGS)2-XTEN-(SGGS)2-nCas9_SGGS_NLS | (D107A_D018N) + (D107A_D108N) |
| pNMG-348 | pCMV_S. aureusTadA-(SGGS)2-XTEN-(SGGS)2-S. aureusTadA-(SGGS)2-XTEN-(SGGS)2-nCas9_SGGS_NLS | (G26P_D107A_D108N) + (G26P_D107A_D108N) |
| pNMG-349 | pCMV_S. aureusTadA-(SGGS)2-XTEN-(SGGS)2-S. aureusTadA-(SGGS)2-XTEN-(SGGS)2-nCas9_sGGS_NLS | (G26P_D107A_D108N_S142A) + (G26P_D107A_D108N_S142A) |
| pNMG-350 | pCMV_S. aureusTadA-(SGGS)2-XTEN-(SGGS)2-S. aureusTadA-(SGGS)2-XTEN-(SGGS)2-nCas9_SGGS_NLS | (D104A_D108N_S142A) + (D107A_D108N_S142A) |
| pNMG-351 | pCMV_ecTadk(SGGS)2-XTEN-(SGGS)2_nCas9_SGGS_NLS | (R26G_L84F_A106V_R107H_D108N_H123Y_A142N_A143D_D147Y_E155V_I156F) |
| pNMG-352 | pCMV_ecTadk(SGGS)2-XTEN-(SGGS)2_nCas9_SGGS_NLS | (E25G_R26G_L84F_A106V_R107H_D108N_H123Y_A142N_A143D_D147Y_E155V_I156F) |
| pNMG-353 | pCMV_ecTadk(SGGS)2-XTEN-(SGGS)2_nCas9_SGGS_NLS | (E25D_R26G_L84F_A106V_R107K_D108N_H123Y_A142N_A143G_D147Y_E155V_I156F) |
| pNMG-354 | pCMV_ecTadk(SGGS)2-XTEN-(SGGS)2_nCas9_SGGS_NLS | (R26Q_L84F_A106V_D108N_H123Y_A142N_D147Y_E155V_I156F) |
| pNMG-355 | pCMV_ecTadk(SGGS)2-XTEN-(SGGS)2_nCas9_SGGS_NLS | (E25M_R26G_L84F_A106V_R107P_D108N_H123Y_A142N_A143D_D147Y_E155V_I156F) |
| pNMG-356 | pCMV_ecTadk(SGGS)2-XTEN-(SGGS)2_nCas9_SGGS_NLS | (R26C_L84F_A106V_R107H_D108N_H123Y_A142N_D147Y_E155V_I156F) |

TABLE 4-continued

Plasmid Identity Key

| Name | Construct Architecture | Mutations in TadA |
|---|---|---|
| pNMG-357 | pCMV_ecTadk(SGGS)2-XTEN-(SGGS)2_nCas9_SGGS_NLS | (L84F_A106V_D108N_H123Y_A142N_A143L_D147Y_E155V_I156F) |
| pNMG-358 | pCMV_ecTadk(SGGS)2-XTEN-(SGGS)2_nCas9_SGGS_NLS | (R26G_L84F_A106V_D108N_H123Y_A142N_D147Y_E155V_I156F) |
| pNMG-359 | pCMV_ecTadk(SGGS)2-XTEN-(SGGS)2_nCas9_SGGS_NLS | (E25A_R26G_L84F_A106V_R107N_D108N_H123Y_A142N_A143E_D147Y_E155V_I156F) |
| pNMG-360 | pCMV_ecTadA-(SGGS)2-XTEN-(SGGS)2-ecTadA-(SGGS)2-XTEN-(SGGS)2_nCas9_SGGS_NLS | (R26G_L84F_A106V_R107H_D108N_H123Y_A142N_A143D_D147Y_E155V_I156F) + (R26G_L84F_A106V_R107H_D108N_H123Y_A142N_A143D_D147Y_E155V_I156F) |
| pNMG-361 | pCMV_ecTadA-(SGGS)2-XTEN-(SGGS)2-ecTadA-(SGGS)2-XTEN-(SGGS)2_nCas9_SGGS_NLS | (E25G_R26G_L84F_A106V_R107H_D108N_H123Y_A142N_A143D_D147Y_E155V_I156F) X 2 |
| pNMG-362 | pCMV_ecTadA-(SGGS)2-XTEN-(SGGS)2-ecTadA-(SGGS)2-XTEN-(SGGS)2_nCas9_SGGS_NLS | (E25D_R26G_L84F_A106V_R107K_D108N_H123Y_A142N_A143G_D147Y_E155V_I156F) X 2 |
| pNMG-363 | pCMV_ecTadA-(SGGS)2-XTEN-(SGGS)2-ecTadA-(SGGS)2-XTEN-(SGGS)2_nCas9_SGGS_NLS | (R26Q_L84F_A106V_D108N_H123Y_A142N_D147Y_E155V_I156F) X 2 |
| pNMG-364 | pCMV_ecTadA-(SGGS)2-XTEN-(SGGS)2-ecTadA-(SGGS)2-XTEN-(SGGS)2_nCas9_SGGS_NLS | (E25M_R26G_L84F_A106V_R107P_D108N_H123Y_A142N_A143D_D147Y_E155V_I156F) X 2 |
| pNMG-365 | pCMV_ecTadA-(SGGS)2-XTEN-(SGGS)2-ecTadA-(SGGS)2-XTEN-(SGGS)2_nCas9_SGGS_NLS | (R26C_L84F_A106V_R107H_D108N_H123Y_A142N_D147Y_E155V_I156F) X 2 |
| pNMG-366 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_A142N_A143L_D147Y_E155V_I156F) X 2 |
| pNMG-367 | pCMV_ecTadA-(SGGS)2-XTEN-(SGGS)2-ecTadA-(SGGS)2-XTEN-(SGGS)2_nCas9_SGGS_NLS | (R26G_L84F_A106V_D108N_H123Y_A142N_D147Y_E155V_I156F) X 2 |
| pNMG-368 | pCMV_ecTadA-(SGGS)2-XTEN-(SGGS)2-ecTadA-(SGGS)2-XTEN-(SGGS)2_nCas9_SGGS_NLS | (E25A_R26G_L84F_A106V_R107N_D108N_H123Y_A142N_A143E_D147Y_E155V_I156F) X 2 |
| pNMG-369 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_D147Y_E155V_I156Y) + (L84F_A106V_D108N_H123Y_D147Y_E155V_I156Y) |
| pNMG-370 | pCMV_ecTadA-(SGGS)2-XTEN-(SGGS)2-ecTadA-(SGGS)2-XTEN-(SGGS)2_nCas9_SGGS_NLS | (A106V_D108N_D147Y_E155V) + (A106V_D108N_D147Y_E155V) |
| pNMG-371 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_D147Y_E155V_I156F) + (L84F_A106V_D108N_H123Y_D147Y_E155V_I156F) |
| pNMG-372 | pCMV_ecTadk(SGGS)2-XTEN-(SGGS)2_Cas9n_SGGS_NLS | A106V_D108N_A142N_D147Y_E155V |
| pNMG-373 | pCMV_ecTadk(SGGS)2-XTEN-(SGGS)2_Cas9n_SGGS_NLS | R26G_A106V_D108N_A142N_D147Y_E155V |
| pNMG-374 | pCMV_ecTadk(SGGS)2-XTEN-(SGGS)2_Cas9n_SGGS_NLS | E25D_R26G_A106V_R107K_D108N_A142N_A143G_D147Y_E155V |
| pNMG-375 | pCMV_ecTadk(SGGS)2-XTEN-(SGGS)2_Cas9n_SGGS_NLS | R26G_A106V_D108N_R107H_A142N_A143D_D147Y_E155V |
| pNMG-376 | pCMV_ecTadk(SGGS)2-XTEN-(SGGS)2_Cas9n_SGGS_NLS | E25D_R26G_A106V_D108N_A142N_D147Y_E155V |
| pNMG-377 | pCMV_ecTadk(SGGS)2-XTEN-(SGGS)2_Cas9n_SGGS_NLS | A106V_R107K_D108N_A142N_D147Y_E155V |
| pNMG-378 | pCMV_ecTadk(SGGS)2-XTEN-(SGGS)2_Cas9n_SGGS_NLS | A106V_D108N_A142N_A143G_D147Y_E155V |

TABLE 4-continued

Plasmid Identity Key

| Name | Construct Architecture | Mutations in TadA |
|---|---|---|
| pNMG-379 | pCMV_ecTadk(SGGS)2-XTEN-(SGGS)2_Cas9n_SGGS_NLS | A106V_D108N_A142N_A143L_D147Y_E155V |
| pNMG-382 | pCMV_ecTadA-(SGGS)2-XTEN-(SGGS)2-ecTadA-(SGGS)2-XTEN-(SGGS)2_nCas9_SGGS_NLS | A106V_D108N_A142N_D147Y_E155V X 2 |
| pNMG-383 | pCMV_ecTadA-(SGGS)2-XTEN-(SGGS)2-ecTadA-(SGGS)2-XTEN-(SGGS)2_nCas9_SGGS_NLS | R26G_A106V_D108N_A142N_D147Y_E155V X 2 |
| pNMG-384 | pCMV_ecTadA-(SGGS)2-XTEN-(SGGS)2-ecTadA-(SGGS)2-XTEN-(SGGS)2_nCas9_SGGS_NLS | E25D_R26G_A106V_R107K_D108N_A142N_A143G_D147Y_E155V X 2 |
| pNMG-385 | pCMV_ecTadA-(SGGS)2-XTEN-(SGGS)2-ecTadA-(SGGS)2-XTEN-(SGGS)2_nCas9_SGGS_NLS | R26G_A106V_D108N_R107H_A142N_A143D_D147Y_E155V X 2 |
| pNMG-386 | pCMV_ecTadA-(SGGS)2-XTEN-(SGGS)2-ecTadA-(SGGS)2-XTEN-(SGGS)2_nCas9_SGGS_NLS | E25D_R26G_A106V_D108N_A142N_D147Y_E155V X 2 |
| pNMG-387 | pCMV_ecTadA-(SGGS)2-XTEN-(SGGS)2-ecTadA-(SGGS)2-XTEN-(SGGS)2_nCas9_SGGS_NLS | A106V_R107K_D108N_A142N_D147Y_E155V X 2 |
| pNMG-388 | pCMV_ecTadA-(SGGS)2-XTEN-(SGGS)2-ecTadA-(SGGS)2-XTEN-(SGGS)2_nCas9_SGGS_NLS | A106V_D108N_A142N_A143G_D147Y_E155V X 2 |
| pNMG-389 | pCMV_ecTadA-(SGGS)2-XTEN-(SGGS)2-ecTadA-(SGGS)2-XTEN-(SGGS)2_nCas9_SGGS_NLS | A106V_D108N_A142N_A143L_D147Y_E155V X 2 |
| pNMG-391 | pCMV_ecTadk(SGGS)2-XTEN-(SGGS)2_Cas9n_SGGS_UGI_SGGS_NLS | H36L_R51L_L84F_A106V_D108N_H123Y_S146C_D147Y_E155V_I156F_K157N |
| pNMG-392 | pCMV_ecTadk(SGGS)2-XTEN-(SGGS)2_Cas9n_SGGS_UGI_SGGS_NLS | N37T_P48T_M70L_L84F_A106V_D108N_H123Y_D147Y_I49V_E155V_I156F |
| pNMG-393 | pCMV_ecTadk(SGGS)2-XTEN-(SGGS)2_Cas9n_SGGS_UGI_SGGS_NLS | N37S_L84F_A106V_D108N_H123Y_D147Y_E155V_I156F_K161T |
| pNMG-394 | pCMV_ecTadk(SGGS)2-XTEN-(SGGS)2_Cas9n_SGGS_UGI_SGGS_NLS | H36L_L84F_A106V_D108N_H123Y_D147Y_Q154H_E155V_I156F |
| pNMG-395 | pCMV_ecTadk(SGGS)2-XTEN-(SGGS)2_Cas9n_SGGS_UGI_SGGS_NLS | N72S_L84F_A106V_D108N_H123Y_S146R_D147Y_E155V_I156F |
| pNMG-396 | pCMV_ecTadk(SGGS)2-XTEN-(SGGS)2_Cas9n_SGGS_UGI_SGGS_NLS | H36L_P48L_L84F_A106V_D108N_H123Y_E134G_D147Y_E155V_I156F |
| pNMG-397 | pCMV_ecTadk(SGGS)2-XTEN-(SGGS)2_Cas9n_SGGS_UGI_SGGS_NLS | H36L_L84F_A106V_D108N_H123Y_D147Y_E155V_I156F_K157N |
| pNMG-398 | pCMV_ecTadk(SGGS)2-XTEN-(SGGS)2_Cas9n_SGGS_UGI_SGGS_NLS | H36L_L84F_A106V_D108N_H123Y_S146C_D147Y_E155V_I156F |
| pNMG-399 | pCMV_ecTadk(SGGS)2-XTEN-(SGGS)2_Cas9n_SGGS_UGI_SGGS_NLS | L84F_A106V_D108N_H123Y_S146R_D147Y_E155V_I156F_K161T |
| pNMG-400 | pCMV_ecTadk(SGGS)2-XTEN-(SGGS)2_Cas9n_SGGS_UGI_SGGS_NLS | N37S_R51H_D77G_L84F_A106V_D108N_H123Y_D147Y_E155V_I156F |
| pNMG-401 | pCMV_ecTadk(SGGS)2-XTEN-(SGGS)2_Cas9n_SGGS_UGI_SGGS_NLS | R51L_L84F_A106V_D108N_H123Y_D147Y_E155V_I156F_K157N |
| pNMG-402 | pCMV_ecTadA-(SGGS)2-XTEN-(SGGS)2-ecTadA-(SGGS)2-XTEN-(SGGS)2_nCas9_SGGS_NLS | (H36L_R51L_L84F_A106V_D108N_H123Y_S146C_D147Y_E155V_I156F_K157N) x 2 |
| pNMG-403 | pCMV_ecTadA-(SGGS)2-XTEN-(SGGS)2-ecTadA-(SGGS)2-XTEN-(SGGS)2_nCas9_SGGS_NLS | (N37T_P48T_M70L_L84F_A106V_D108N_H123Y_D147Y_I49V_E155V_I156F) x 2 |
| pNMG-404 | pCMV_ecTadA-(SGGS)2-XTEN-(SGGS)2-ecTadA-(SGGS)2-XTEN-(SGGS)2_nCas9_SGGS_NLS | (N37S_L84F_A106V_D108N_H123Y_D147Y_E155V_I156F_K161T) x 2 |
| pNMG-405 | pCMV_ecTadA-(SGGS)2-XTEN-(SGGS)2-ecTadA-(SGGS)2-XTEN-(SGGS)2_nCas9_SGGS_NLS | (H36L_L84F_A106V_D108N_H123Y_D147Y_Q154H_E155V_I156F) x 2 |
| pNMG-406 | pCMV_ecTadA-(SGGS)2-XTEN-(SGGS)2-ecTadA-(SGGS)2-XTEN-(SGGS)2_nCas9_SGGS_NLS | (N72S_L84F_A106V_D108N_H123Y_S146R_D147Y_E155V_I156F) x 2 |

TABLE 4-continued

Plasmid Identity Key

| Name | Construct Architecture | Mutations in TadA |
|---|---|---|
| pNMG-407 | pCMV_ecTadA-(SGGS)2-XTEN-(SGGS)2-ecTadA-(SGGS)2-XTEN-(SGGS)2_nCas9_SGGS_NLS | (H36L_P48L_L84F_A106V_D108N_H123Y_E134G_D147Y_E155V_I156F) x 2 |
| pNMG-408 | pCMV_ecTadA-(SGGS)2-XTEN-(SGGS)2-ecTadA-(SGGS)2-XTEN-(SGGS)2_nCas9_SGGS_NLS | (H36L_L84F_A106V_D108N_H123Y_D147Y_E155V_I156F_K157N) x 2 |
| pNMG-409 | pCMV_ecTadA-(SGGS)2-XTEN-(SGGS)2-ecTadA-(SGGS)2-XTEN-(SGGS)2_nCas9_SGGS_NLS | (H36L_L84F_A106V_D108N_H123Y_S146C_D147Y_E155V_I156F) x 2 |
| pNMG-410 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_S146R_D147Y_E155V_I156F_K161T) x 2 |
| pNMG-411 | pCMV_ecTadA-(SGGS)2-XTEN-(SGGS)2-ecTadA-(SGGS)2-XTEN-(SGGS)2_nCas9_SGGS_NLS | (N37S_R51H_D77G_L84F_A106V_D108N_H123Y_D147Y_E155V_I156F) x 2 |
| pNMG-412 | pCMV_ecTadA-(SGGS)2-XTEN-(SGGS)2-ecTadA-(SGGS)2-XTEN-(SGGS)2_nCas9_SGGS_NLS | (R51L_L84F_A106V_D108N_H123Y_D147Y_E155V_I156F_K157N) x 2 |
| pNMG-440 | pCMV_ecTadk(SGGS)2-XTEN-(SGGS)2_Cas9n_SGGS_UGI_SGGS_NLS | D24G_Q71R_L84F_H96L_A106V_D108N_H123Y_D147Y_E155V_I156F_K160E |
| pNMG-441 | pCMV_ecTadk(SGGS)2-XTEN-(SGGS)2_Cas9n_SGGS_UGI_SGGS_NLS | H36L_G67V_L84F_A106V_D108N_H123Y_S146T_D147Y_E155V_I156F |
| pNMG-442 | pCMV_ecTadk(SGGS)2-XTEN-(SGGS)2_Cas9n_SGGS_UGI_SGGS_NLS | Q71L_L84F_A106V_D108N_H123Y_L137M_A143E_D147Y_E155V_I156F |
| pNMG-443 | pCMV_ecTadk(SGGS)2-XTEN-(SGGS)2_Cas9n_SGGS_UGI_SGGS_NLS | E25G_L84F_A106V_D108N_H123Y_D147Y_E155V_I156F_Q159L |
| pNMG-444 | pCMV_ecTadk(SGGS)2-XTEN-(SGGS)2_Cas9n_SGGS_UGI_SGGS_NLS | L84F_A91T_F104I_A106V_D108N_H123Y_D147Y_E155V_I156F |
| pNMG-445 | pCMV_ecTadk(SGGS)2-XTEN-(SGGS)2_Cas9n_SGGS_UGI_SGGS_NLS | N72D_L84F_A106V_D108N_H123Y_G125A_D147Y_E155V_I156F |
| pNMG-446 | pCMV_ecTadk(SGGS)2-XTEN-(SGGS)2_Cas9n_SGGS_UGI_SGGS_NLS | P48S_L84F_S97C_A106V_D108N_H123Y_D147Y_E155V_I156F |
| pNMG-447 | pCMV_ecTadk(SGGS)2-XTEN-(SGGS)2_Cas9n_SGGS_UGI_SGGS_NLS | W23G_L84F_A106V_D108N_H123Y_D147Y_E155V_I156F |
| pNMG-448 | pCMV_ecTadk(SGGS)2-XTEN-(SGGS)2_Cas9n_SGGS_UGI_SGGS_NLS | D24G_P48L_Q71R_L84F_A106V_D108N_H123Y_D147Y_E155V_I156F_Q159L |
| pNMG-449 | pCMV_ecTadA-(SGGS)2-XTEN-(SGGS)2-ecTadA-(SGGS)2-XTEN-(SGGS)2_nCas9_SGGS_NLS | (D24G_Q71R_L84F_H96L_A106V_D108N_H123Y_D147Y_E155V_I156F_K160E) x 2 |
| pNMG-450 | pCMV_ecTadA-(SGGS)2-XTEN-(SGGS)2-ecTadA-(SGGS)2-XTEN-(SGGS)2_nCas9_SGGS_NLS | (H36L_G67V_L84F_A106V_D108N_H123Y_S146T_D147Y_E155V_I156F) x 2 |
| pNMG-451 | pCMV_ecTadA-(SGGS)2-XTEN-(SGGS)2-ecTadA-(SGGS)2-XTEN-(SGGS)2_nCas9_SGGS_NLS | (Q71L_L84F_A106V_D108N_H123Y_L137M_A143E_D147Y_E155V_I156F) x 2 |
| pNMG-452 | pCMV_ecTadA-(SGGS)2-XTEN-(SGGS)2-ecTadA-(SGGS)2-XTEN-(SGGS)2_nCas9_SGGS_NLS | (E25G_L84F_A106V_D108N_H123Y_D147Y_E155V_I156F_Q159L) x 2 |
| pNMG-453 | pCMV_ecTadA-(SGGS)2-XTEN-(SGGS)2-ecTadA-(SGGS)2-XTEN-(SGGS)2_nCas9_SGGS_NLS | (L84F_A91T_F104I_A106V_D108N_H123Y_D147Y_E155V_I156F) x 2 |
| pNMG-454 | pCMV_ecTadA-(SGGS)2-XTEN-(SGGS)2-ecTadA-(SGGS)2-XTEN-(SGGS)2_nCas9_SGGS_NLS | (N72D_L84F_A106V_D108N_H123Y_G125A_D147Y_E155V_I156F) x 2 |
| pNMG-455 | pCMV_ecTadA-(SGGS)2-XTEN-(SGGS)2-ecTadA-(SGGS)2-XTEN-(SGGS)2_nCas9_SGGS_NLS | (P48S_L84F_S97C_A106V_D108N_H123Y_D147Y_E155V_I156F) x 2 |
| pNMG-456 | pCMV_ecTadA-(SGGS)2-XTEN-(SGGS)2-ecTadA-(SGGS)2-XTEN-(SGGS)2_nCas9_SGGS_NLS | (W23G_L84F_A106V_D108N_H123Y_D147Y_E155V_I156F) x 2 |
| pNMG-457 | pCMV_ecTadA-(SGGS)2-XTEN-(SGGS)2-ecTadA-(SGGS)2-XTEN-(SGGS)2_nCas9_SGGS_NLS | (D24G_P48L_Q71R_L84F_A106V_D108N_H123Y_D147Y_E155V_I156F_Q159L) x 2 |
| pNMG-473 | pCMV_ecTadk(SGGS)2-XTEN-(SGGS)2_Cas9n_SGGS_UGI_SGGS_NLS | L84F_A106V_D108N_H123Y_A142N_D147Y_E155V_I156F |

TABLE 4-continued

Plasmid Identity Key

| Name | Construct Architecture | Mutations in TadA |
|---|---|---|
| pNMG-474 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_A142N_D147Y_E155V_I156F) x 2 |
| pNMG-475 | pCMV_ecTadA-(SGGS)2-XTEN-(SGGS)2-ecTadA-(SGGS)2-XTEN-(SGGS)2_nCas9_SGGS_NLS | (wild-typet) + (A106V_D108N_D147Y_E155V) |
| pNMG-476 | pCMV_ecTadA-(SGGS)2-XTEN-(SGGS)2-ecTadA-(SGGS)2-XTEN-(SGGS)2_nCas9_SGGS_NLS | (wild-type) + (L84F_A106V_D108N_H123Y_D147Y_E155V_I156F) |
| pNMG-477 | pCMV_ecTadA-(SGGS)2-XTEN-(SGGS)2-ecTadA-(SGGS)2-XTEN-(SGGS)2_nCas9_SGGS_NLS | (wild-type) + (H36L_R51L_L84F_A106V_D108N_H123Y_S146C_D147Y_E155V_I156F_K157N) |
| pNMG-478 | pCMV_ecTadA-(SGGS)2-XTEN-(SGGS)2-ecTadA-(SGGS)2-XTEN-(SGGS)2_nCas9_SGGS_NLS | (wild-type) + (N37S_L84F_A106V_D108N_H123Y_D147Y_E155V_I156F_K161T) |
| pNMG-479 | pCMV_ecTadA-(SGGS)2-XTEN-(SGGS)2-ecTadA-(SGGS)2-XTEN-(SGGS)2_nCas9_SGGS_NLS | (wild-type) + (L84F_A106V_D108N_H123Y_S146R_D147Y_E155V_I156F_K161T) |
| pNMG-480 | pCMV_ecTadk(SGGS)2-XTEN-(SGGS)2_Cas9n_SGGS_NLS | wild-type |
| pNMG-481 | pCMV_ecTadk(SGGS)2-XTEN-(SGGS)2_Cas9n_SGGS_NLS | A106V_D108N |
| pNMG-482 | pCMV_ecTadA-(SGGS)2-XTEN-(SGGS)2-ecTadA-(SGGS)2-XTEN-(SGGS)2_nCas9_SGGS_NLS | wild-type + wild-type |
| pNMG-483 | pCMV_ecTadA-(SGGS)2-XTEN-(SGGS)2-ecTadA-(SGGS)2-XTEN-(SGGS)2_nCas9_SGGS_NLS | (A106V_D108N) x2 |
| pNMG-484 | pCMV_ecTadA-(SGGS)2-XTEN-(SGGS)2-ecTadA-(SGGS)2-XTEN-(SGGS)2_nCas9_SGGS_NLS | (wild-type) + (A106V_D108N) |
| pNMG-485 | pCMV_ecTadk(SGGS)2-XTEN-(SGGS)2_Cas9n_SGGS_UGI_SGGS_NLS | H36L_R51L_L84F_A106V_D108N_H123Y_A142N_S146C_D147Y_E155V_I156F_K157N |
| pNMG-486 | pCMV_ecTadk(SGGS)2-XTEN-(SGGS)2_Cas9n_SGGS_UGI_SGGS_NLS | N37S_L84F_A106V_D108N_H123Y_A142N_D147Y_E155V_I156F_K161T |
| pNMG-487 | pCMV_ecTadk(SGGS)2-XTEN-(SGGS)2_Cas9n_SGGS_UGI_SGGS_NLS | L84F_A106V_D108N_D147Y_E155V_I156F |
| pNMG-488 | pCMV_ecTadk(SGGS)2-XTEN-(SGGS)2_Cas9n_SGGS_UGI_SGGS_NLS | R51L_L84F_A106V_D108N_H123Y_S146C_D147Y_E155V_I156F_K157N_K161T |
| pNMG-489 | pCMV_ecTadk(SGGS)2-XTEN-(SGGS)2_Cas9n_SGGS_UGI_SGGS_NLS | L84F_A106V_D108N_H123Y_S146C_D147Y_E155V_I156F_K161T |
| pNMG-490 | pCMV_ecTadk(SGGS)2-XTEN-(SGGS)2_Cas9n_SGGS_UGI_SGGS_NLS | L84F_A106V_D108N_H123Y_S146C_D147Y_E155V_I156F_K157N_K160E_K161T |
| pNMG-491 | pCMV_ecTadk(SGGS)2-XTEN-(SGGS)2_Cas9n_SGGS_UGI_SGGS_NLS | L84F_A106V_D108N_H123Y_S146C_D147Y_E155V_I156F_K157N_K160E |
| pNMG-492 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_A142N_D147Y_E155V_I156F) |
| pNMG-493 | pCMV_ecTadA-(SGGS)2-XTEN-(SGGS)2-ecTadA-(SGGS)2-XTEN-(SGGS)2_nCas9_SGGS_NLS | (wt) + (D24G_Q71R_L84F_H96L_A106V_D108N_H123Y_D147Y_E155V_I156F_K160E) |
| pNMG-494 | pCMV_ecTadA-(SGGS)2-XTEN-(SGGS)2-ecTadA-(SGGS)2-XTEN-(SGGS)2_nCas9_SGGS_NLS | (wt) + (H36L_R51L_L84F_A106V_D108N_H123Y_A142N_S146C_D147Y_E155V_I156F_K157N) |
| pNMG-495 | pCMV_ecTadA-(SGGS)2-XTEN-(SGGS)2-ecTadA-(SGGS)2-XTEN-(SGGS)2_nCas9_SGGS_NLS | (wt) + (N37S_L84F_A106V_D108N_H123Y_A142N_D147Y_E155V_I156F_K161T) |
| pNMG-496 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_D147Y_E155V_I156F) |

TABLE 4-continued

Plasmid Identity Key

| Name | Construct Architecture | Mutations in TadA |
|---|---|---|
| pNMG-497 | pCMV_ecTadA-(SGGS)2-XTEN-(SGGS)2-ecTadA-(SGGS)2-XTEN-(SGGS)2_nCas9_SGGS_NLS | (wt) + (R51L_L84F_A106V_D108N_H123Y_S146C_D147Y_E155V_I156F_K157N_K161T) |
| pNMG-498 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_S146C_D147Y_E155V_I156F_K161T) |
| pNMG-499 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_S146C_D147Y_E155V_I156F_K157N_K160E_K161T) |
| pNMG-500 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_S146C_D147Y_E155V_I156F_K157N_K160E) |
| pNMG-513 | pCMV_ecTadA-92 a.a.-ecTadA-32 a.a._nCas9_SGGS_NLS | (wt) + (L84F_A106V_D108N_H123Y_D147Y_E155V_I156F) |
| pNMG-514 | pCMV_ecTadA-92 a.a.-ecTadA-32 a.a._nCas9_SGGS_NLS | (L84F_A106V_D108N_H123Y_D147Y_E155V_I156F) + (L84F_A106V_D108N_H123Y_D147Y_E155V_I156F) |
| pNMG-515 | pCMV_ecTadA-92 a.a.-ecTadA-64 a.a._nCas9_SGGS_NLS | (wt) + (L84F_A106V_D108N_H123Y_D147Y_E155V_I156F) |
| pNMG-516 | pCMV_ecTadA-92 a.a.-ecTadA-64 a.a._nCas9_SGGS_NLS | (L84F_A106V_D108N_H123Y_D147Y_E155V_I156F) + (L84F_A106V_D108N_H123Y_D147Y_E155V_I156F) |
| pNMG-517 | pCMV_ecTadA-32 a.a.-ecTadA-64 a.a._nCas9_SGGS_NLS | (wt) + (L84F_A106V_D108N_H123Y_D147Y_E155V_I156F) |
| pNMG-518 | pCMV_ecTadA-32 a.a.-ecTadA-64 a.a._nCas9_SGGS_NLS | (L84F_A106V_D108N_H123Y_D147Y_E155V_I156F) + (L84F_A106V_D108N_H123Y_D147Y_E155V_I156F) |
| pNMG-519 | pCMV_ecTadA-32 a.a.-_nCas9_SGGS_NLS | R74Q |
| pNMG-520 | pCMV_ecTadA-32 a.a.-_nCas9_SGGS_NLS | R74Q L84F_A106V_D108N_H123Y_D147Y_E155V_I156F |
| pNMG-521 | pCMV_ecTadA-32 a.a.-_nCas9_SGGS_NLS | R74A_L84F_A106V_D108N_H123Y_D147Y_E155V_I156F |
| pNMG-522 | pCMV_ecTadA-32 a.a.-_nCas9_SGGS_NLS | R98Q |
| pNMG-523 | pCMV_ecTadA-32 a.a.-_nCas9_SGGS_NLS | R129Q |
| pNMG-524 | pCMV_ecTadA-(SGGS)2-XTEN-(SGGS)2-ecTadA-(SGGS)2-XTEN-(SGGS)2_nCas9_SGGS_NLS | (wt + R74Q) + (L84F_A106V_D108N_H123Y_D147Y_E155V_I156F) |
| pNMG-525 | pCMV_ecTadA-(SGGS)2-XTEN-(SGGS)2-ecTadA-(SGGS)2-XTEN-(SGGS)2_nCas9_SGGS_NLS | (wt + R74Q) + (R74Q_L84F_A106V_D108N_H123Y_D147Y_E155V_I156F) |
| pNMG-526 | pCMV_ecTadA-(SGGS)2-XTEN-(SGGS)2-ecTadA-(SGGS)2-XTEN-(SGGS)2_nCas9_SGGS_NLS | (R74A_L84F_A106V_D108N_H123Y_D147Y_E155V_I156F) + (R74A_L84F_A106V_D108N_H123Y_D147Y_E155V_I156F) |
| pNMG-527 | pCMV_ecTadA-(SGGS)2-XTEN-(SGGS)2-ecTadA-(SGGS)2-XTEN-(SGGS)2_nCas9_SGGS_NLS | (wt + R98Q) + (L84F_R98Q_A106V_D108N_H123Y_D147Y_E155V_I156F) |

TABLE 4-continued

Plasmid Identity Key

| Name | Construct Architecture | Mutations in TadA |
|---|---|---|
| pNMG-528 | pCMV_ecTadA-(SGGS)2-XTEN-(SGGS)2-ecTadA-(SGGS)2-XTEN-(SGGS)2_nCas9_SGGS_NLS | (wt + R129Q) + (L84F_A106V_D108N_H123Y_R129Q_D147Y_E155V_I156F) |
| pNMG-529 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_D147Y_E155V_I156F) + (H36L_R51L_L84F_A106V_D108N_H123Y_S146C_D147Y_E155V_I156F_K157N) |
| pNMG-530 | pCMV_ecTadA-(SGGS)2-XTEN-(SGGS)2-ecTadA-(SGGS)2-XTEN-(SGGS)2_nCas9_SGGS_NLS | (H36L_R51L_L84F_A106V_D108N_H123Y_S146C_D147Y_E155V_I156F_K157N) + (L84F_A106V_D108N_H123Y_D147Y_E155V_I156F) |
| pNMG-543 | pCMV_ecTadA-(SGGS)2-XTEN-(SGGS)2_nCas9_SGGS_NLS | (P48S_L84F_A106V_D108N_H123Y_A142N_D147Y_E155V_I156F) |
| pNMG-544 | pCMV_ecTadA-(SGGS)2-XTEN-(SGGS)2_nCas9_SGGS_NLS | (P48T_I49V_L84F_A106V_D108N_H123Y_A142N_D147Y_E155V_I156F_L157N) |
| pNMG-545 | pCMV_ecTadA-(SGGS)2-XTEN-(SGGS)2_nCas9_SGGS_NLS | P48S_A142N |
| pNMG-546 | pCMV_ecTadA-(SGGS)2-XTEN-(SGGS)2_nCas9_SGGS_NLS | P48T_I49V_A142N |
| pNMG-547 | pCMV_ecTadA-(SGGS)2-XTEN-(SGGS)2-ecTadA-(SGGS)2-XTEN-(SGGS)2_nCas9_SGGS_NLS | (wt) + (P48S_L84F_A106V_D108N_H123Y_A142N_D147Y_E155V_I156F) |
| pNMG-548 | pCMV_ecTadA-(SGGS)2-XTEN-(SGGS)2-ecTadA-(SGGS)2-XTEN-(SGGS)2_nCas9_SGGS_NLS | (P48S_L84F_A106V_D108N_H123Y_A142N_D147Y_E155V_I156F) + (P48S_L84F_A106V_D108N_H123Y_A142N_D147Y_E155V_I156F)) |
| pNMG-549 | pCMV_ecTadA-(SGGS)2-XTEN-(SGGS)2-ecTadA-(SGGS)2-XTEN-(SGGS)2_nCas9_SGGS_NLS | (P48S_A142N) + (P48S_L84F_A106V_D108N_H123Y_A142N_D147Y_E155V_I156F)) |
| pNMG-550 | pCMV_ecTadA-(SGGS)2-XTEN-(SGGS)2-ecTadA-(SGGS)2-XTEN-(SGGS)2_nCas9_SGGS_NLS | (P48S_A142N) + (L84F_A106V_D108N_H123Y_D147Y_E155V_I156F) |
| pNMG-551 | pCMV_ecTadA-(SGGS)2-XTEN-(SGGS)2-ecTadA-(SGGS)2-XTEN-(SGGS)2_nCas9_SGGS_NLS | (wt) + (P48T_I49V_L84F_A106V_D108N_H123Y_A142N_D147Y_E155V_I156F_L157N) |
| pNMG-552 | pCMV_ecTadA-(SGGS)2-XTEN-(SGGS)2-ecTadA-(SGGS)2-XTEN-(SGGS)2_nCas9_SGGS_NLS | (P48T_I49V_L84F_A106V_D108N_H123Y_A142N_D147Y_E155V_156F_L157N) + (P48T_I49V_L84F_A106V_D108N_H123Y_A142N_147Y_E155V_I156F_L157N) |
| pNMG-553 | pCMV_ecTadA-(SGGS)2-XTEN-(SGGS)2-ecTadA-(SGGS)2-XTEN-(SGGS)2_nCas9_SGGS_NLS | (P48T_I49V_A142N) + (P48T_I49V_L84F_A106V_D108N_H123Y_A142N_D147Y_E155V_I156F_L157N) |
| pNMG-554 | pCMV_ecTadA-(SGGS)2-XTEN-(SGGS)2-ecTadA-(SGGS)2-XTEN-(SGGS)2_nCas9_SGGS_NLS | (P48T_I49V_A142N) + (L84F_A106V_D108N_H123Y_D147Y_E155V_I156F) |
| pNMG-555 | pCMV_ecTadA-24 a.a. linker-ecTadA-24 a.a. linker_nCas9_SGGS_NLS | (wt) + (H36L_R51L_L84F_A106V_D108N_H123Y_S146C_D147Y_E155V_I156F_K157N) |
| pNMG-556 | pCMV_ecTadA-24 a.a linker-ecTadA-32 a.a. linker_nCas9_SGGS_NLS | (wt) + (H36L_R51L_L84F_A106V_D108N_H123Y_S146C_D147Y_E155V_I156F_K157N) |
| pNMG-557 | pCMV_ecTadA-24 a.a linker-ecTadA-40 a.a. linker_nCas9_SGGS_NLS | (wt) + (H36L_R51L_L84F_A106V_D108N_H123Y_S146C_D147Y_E155V_I156F_K157N) |
| pNMG-558 | pCMV_ecTadA-32 a.a. linker-ecTadA-24 a.a. linker_nCas9_SGGS_NLS | (wt) + (H36L_R51L_L84F_A106V_D108N_H123Y_S146C_D147Y_E155V_I156F_K157N) |

TABLE 4-continued

Plasmid Identity Key

| Name | Construct Architecture | Mutations in TadA |
|---|---|---|
| pNMG-559 | pCMV_ecTadA-32 a.a. linker-ecTadA-40 a.a. linker_nCas9_SGGS_NLS | (wt) + (H36L_R51L_L84F_A106V_D108N_H123Y_S146C_D147Y_E155V_I156F_K157N) |
| pNMG-560 | pCMV_ecTadA-40 a.a. linker-ecTadA-24 a.a. linker_nCas9_SGGS_NLS | (wt) + (H36L_R51L_L84F_A106V_D108N_H123Y_S146C_D147Y_E155V_I156F_K157N) |
| pNMG-561 | pCMV_ecTadA-40 a.a. linker-ecTadA-32 a.a. linker_nCas9_SGGS_NLS | (wt) + (H36L_R51L_L84F_A106V_D108N_H123Y_S146C_D147Y_E155V_I156F_K157N) |
| pNMG-562 | pCMV_ecTadA-40 a.a. linker-ecTadA-40 a.a. linker_nCas9_SGGS_NLS | (wt) + (H36L_R51L_L84F_A106V_D108N_H123Y_S146C_D147Y_E155V_I156F_K157N) |
| pNMG-563 | pCMV_ecTadA-24 a.a. linker_nCas9_SGGS_NLS | wild-type |
| pNMG-564 | pCMV_ecTadA-24 a.a. linker_nCas9 SGGS NLS | (H36L_R51L_L84F_A106V_D108N_H123Y_S146C_D147Y_E155V_I156F_K157N) |
| pNMG-565 | pCMV_ecTadA-(SGGS)2-XTEN-(SGGS)2-ecTadA-(SGGS)2-XTEN-(SGGS)2_nCas9 XTEN_MBD4_SGGS_NLS | (wt) + (H36L_R51L_L84F_A106V_D108N_H123Y_S146C_D147Y_E155V_I156F_K157N) |
| pNMG-566 | pCMV_ecTadA-(SGGS)2-XTEN-(SGGS)2-ecTadA-(SGGS)2-XTEN-(SGGS)2_nCas9_XTEN_TDG_SGGS_NLS | (wt) + (H36L_R51L_L84F_A106V_D108N_H123Y_S146C_D147Y_E155V_I156F_K157N) |
| pNMG-572 | pCMV_ecTadA-32 a.a.-_nCas9_SGGS_NLS | (H36L_P48S_R51L_L84F_A106V_D108N_H123Y_S146C_D147Y_E155V_I156F_K157N) |
| pNMG-573 | pCMV_ecTadA-32 a.a.-_nCas9_SGGS_NLS | (H36L_P48S_R51L_L84F_A106V_D108N_H123Y_S146C_A142N_D147Y_E155V_I156F_K157N) |
| pNMG-574 | pCMV_ecTadA-32 a.a.-_nCas9_SGGS_NLS | (H36L_P48T_I49V_R51L_L84F_A106V_D108N_H123Y_S146C_D147Y_E155V_I156F_K157N) |
| pNMG-575 | pCMV_ecTadA-32 a.a.-_nCas9_SGGS_NLS | (H36L_P48T_I49V_R51L_L84F_A106V_D108N_H123Y_A142N_S146C_D147Y_E155V_I156F_K157N) |
| pNMG-576 | pCMV_ecTadA-(SGGS)2-XTEN-(SGGS)2-ecTadA-(SGGS)2-XTEN-(SGGS)2_nCas9_SGGS_NLS | (wt) + (H36L_P48S_R51L_L84F_A106V_D108N_H123Y_S146C_D147Y_E155V_I156F_K157N) |
| pNMG-577 | pCMV_ecTadA-(SGGS)2-XTEN-(SGGS)2-ecTadA-(SGGS)2-XTEN-(SGGS)2_nCas9_SGGS_NLS | (wt) + (H36L_P48S_R51L_L84F_A106V_D108N_H123Y_S146C_A142N_D147Y_E155V_I156F_K157N) |
| pNMG-578 | pCMV_ecTadA-(SGGS)2-XTEN-(SGGS)2-ecTadA-(SGGS)2-XTEN-(SGGS)2_nCas9_SGGS_NLS | (wt) + (H36L_P48T_I49V_R51L_L84F_A106V_D108N_H123Y_S146C_D147Y_E155V_I156F_K157N) |
| pNMG-579 | pCMV_ecTadA-(SGGS)2-XTEN-(SGGS)2-ecTadA-(SGGS)2-XTEN-(SGGS)2_nCas9_SGGS_NLS | (wt) + (H36L_P48T_I49V_R51L_L84F_A106V_D108N_H123Y_A142N_S146C_D147Y_E155V_I156F_K157N) |
| pNMG-580 | pCMV_ecTadA-(SGGS)2-XTEN-(SGGS)2-ecTadA-(SGGS)2-XTEN-(SGGS)2_nCas9_SGGS_NLS | (H36L_P48S_R51L_L84F_A106V_D108N_H123Y_S146C_D147Y_E155V_I156F_K157N) + (H36L_P48S_R51L_L84F_A106V_D108N_H123Y_S146C_D147Y_E155V_I156F_K157N) |
| pNMG-581 | pCMV_ecTadA-32 a.a.-_nCas9_SGGS_NLS | (H36L_P48A_R51L_L84F_A106V_D108N_H123Y_S146C_D147Y_E155V_I156F_K157N) |
| pNMG-583 | pCMV_ecTadA-32 a.a.-_nCas9_SGGS_NLS | (H36L_P48A_R51L_L84F_A106V_D108N_H123Y_A142N_S146C_D147Y_E155V_I156F_K157N) |

TABLE 4-continued

Plasmid Identity Key

| Name | Construct Architecture | Mutations in TadA |
|---|---|---|
| pNMG-586 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_S146C_D147Y_E155V_I156F_K157N) |
| pNMG-588 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_S146C_A142N_D147Y_E155V_I156F_K157N) |
| pNMG-603 | pCMV_ecTadA-32 a.a.-_nCas9_SGGS_NLS | (W23L_H36L_P48A_R51L_L84F_A106V_D108N_H123Y_S146C_D147Y_E155V_I156F_K157N) |
| pNMG-604 | pCMV_ecTadA-32 a.a.-_nCas9_SGGS_NLS | (W23R_H36L_P48A_R51L_L84F_A106V_D108N_H123Y_S146C_D147Y_E155V_I156F_K157N) |
| pNMG-605 | pCMV_ecTadA-32 a.a.-_nCas9_SGGS_NLS | (W23L_H36L_P48A_R51L_L84F_A106V_D108N_H123Y_S146R_D147Y_E155V_I156F_K161T) |
| pNMG-606 | pCMV_ecTadA-32 a.a.-_nCas9_SGGS_NLS | (H36L_P48A_R51L_L84F_A106V_D108N_H123Y_S146C_D147Y_R152H_E155V_I156F_K157N) |
| pNMG-607 | pCMV_ecTadA-32 a.a.-_nCas9_SGGS_NLS | (H36L_P48A_R51L_L84F_A106V_D108N_H123Y_S146C_D147Y_R152P_E155V_I156F_K157N) |
| pNMG-608 | pCMV_ecTadA-32 a.a.-_nCas9_SGGS_NLS | (W23L_H36L_P48A_R51L_L84F_A106V_D108N_H123Y_S146C_D147Y_R152P_E155V_I156F_K157N) |
| pNMG-609 | pCMV_ecTadA-32 a.a._nCas9_SGGS_NLS | (W23L_H36L_P48A_R51L_L84F_A106V_D108N_H123Y_A142A_S146C_D147Y_E155V_I156F_K157N) |
| pNMG-610 | pCMV_ecTadA-32 a.a.-_nCas9_SGGS_NLS | (W23L_H36L_P48A_R51L_L84F_A106V_D108N_H123Y_A142A_S146C_D147Y_R152P_E155V_I156F_K157N) |
| pNMG-611 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_S146C_D147Y_E155V_I156F_K157N) |
| pNMG-612 | pCMV_ecTadA-(SGGS)2-XTEN-(SGGS)2-ecTadA-(SGGS)2-XTEN-(SGGS)2_nCas9_SGGS_NLS | (wt) + (W23R_H36L_P48A_R51L_L84F_A106V_D108N_H123Y_S146C_D147Y_E155V_I156F_K157N) |
| pNMG-613 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_S146R_D147Y_E155V_I156F_K161T) |
| pNMG-614 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_S146C_D147Y_R152H_E155V_I156F_K157N) |
| pNMG-615 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_S146C_D147Y_R152P_E155V_I156F_K157N) |
| pNMG-616 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_S146C_D147Y_R152P_E155V_I156F_K157N) |
| pNMG-617 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_A142A_S146C_D147Y_E155V_I156F_K157N) |

TABLE 4-continued

Plasmid Identity Key

| Name | Construct Architecture | Mutations in TadA |
|---|---|---|
| pNMG-618 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_A142A_S146C_D147Y_R152P_E155V_I156F_K157N) |
| pNMG-619 | pCMV_ecTadA-32 a.a.-_nCas9_SGGS_NLS | (W23R_H36L_P48A_R51L_L84F_A106V_D108N_H123Y_S146C_D147Y_R152P_E155V_I156F_K157N) |
| pNMG-620 | pCMV_ecTadA-(SGGS)2-XTEN-(SGGS)2-ecTadA-(SGGS)2-XTEN-(SGGS)2_nCas9_SGGS_NLS | (wt) + (W23R_H36L_P48A_R51L_L84F_A106V_D108N_H123Y_S146C_D147Y_R152P_E155V_I156F_K157N) |
| pNMG-621 | pCMV_ecTadA-32 a.a. linker-ecTadA-24 a.a. linker_nCas9_SGGS_NLS | (wt) + (H36L_P48A_R51L_L84F_A106V_D108N_H123Y_S146C_D147Y_R152P_E155V_I156F_K157N) |
| pNMG-622 | pCMV_ecTadA-32 a.a. linker-ecTadA-24 a.a. linker_nCas9_SGGS_NLS | (wt) + (H36L_P48A_R51L_L84F_A106V_D108N_H123Y_A142N_S146C_D147Y_R152P_E155V_I156F_K157N) |
| pNMG-623 | pCMV_ecTadA-32 a.a. linker-ecTadA-24 a.a. linker_nCas9_SGGS_NLS | (wt) + (W23L_H36L_P48A_R51L_L84F_A106V_D108N_H123Y_S146C_D147Y_R152P_E155V_I156F_K157N) |
| pNMG-624 | pCMV_ecTadA-32 a.a. linker-ecTadA-24 a.a. linker_nCas9_SGGS_NLS | (wt) + (W23R_H36L_P48A_R51L_L84F_A106V_D108N_H123Y_S146C_D147Y_R152P_E155V_I156F_K157N) |

Example 2—Evolution of Adenosine Base Editor Containing the D108N Mutation of ecTadA (Evolution #2)

An ecTadA construct with a D108N (pNMG-128) mutation was mutagenized via error-prone PCR, as in Evolution #1, and this library was selected against the same chloramphenicol site, except higher concentrations of chloramphenicol was used in the selection media to increase the stringency of the selection. This round of selection produced two new mutations which improved the editing efficiencies of ABE: D147Y and E155V.

In the first round of evolution, error-prone PCR was conducted on the ecTadA deaminase portion of a ecTadA-XTEN-dCas9 fusion construct followed by USER assembly to create a library of ecTadA-XTEN-dCas9 variants (varied only in the deaminase portion). These library members were transformed into S1030 cells containing a selection plasmid, which contained a single G to A point mutation in the active site portion of the chloramphenicol resistance gene. Cells were cultured overnight and plated on concentrations of chloramphenicol which were higher than the MIC of the S1030 cells with the selection plasmid. Surviving colonies were sub-cloned and re-challenged under the selection conditions and then sequenced to identify the genotype of the productive variants. Sanger sequencing analysis revealed that a D108N, a D108V, and a D108G mutation conferred the desired phenotype (A to G transition mutation in DNA). Subsequent studies involving individual clones isolated from this first round of evolution demonstrated that the D108N mutation was the optimal substitution at this site.

Figure 17:
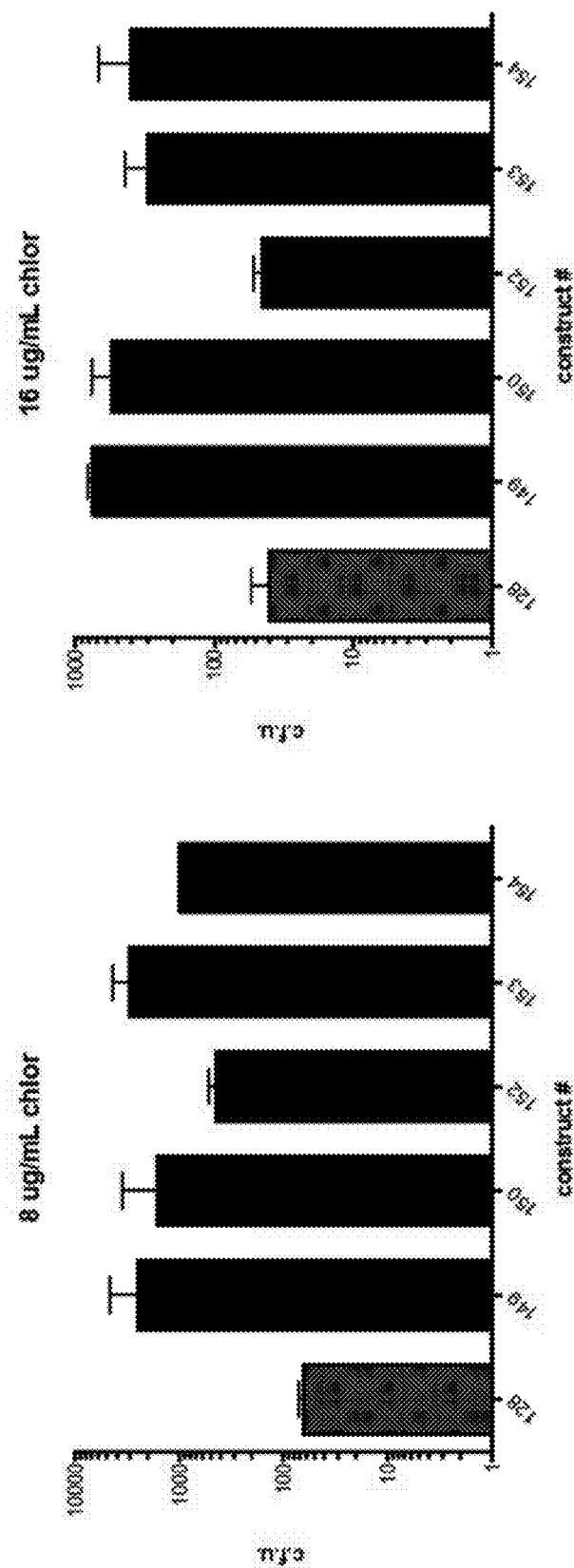
FIG. 17 shows the results of individual clone antibiotic challenge assays. The identity of the construct numbers correspond to the pNMG clone numbers from FIG. 16.
Figure 17:
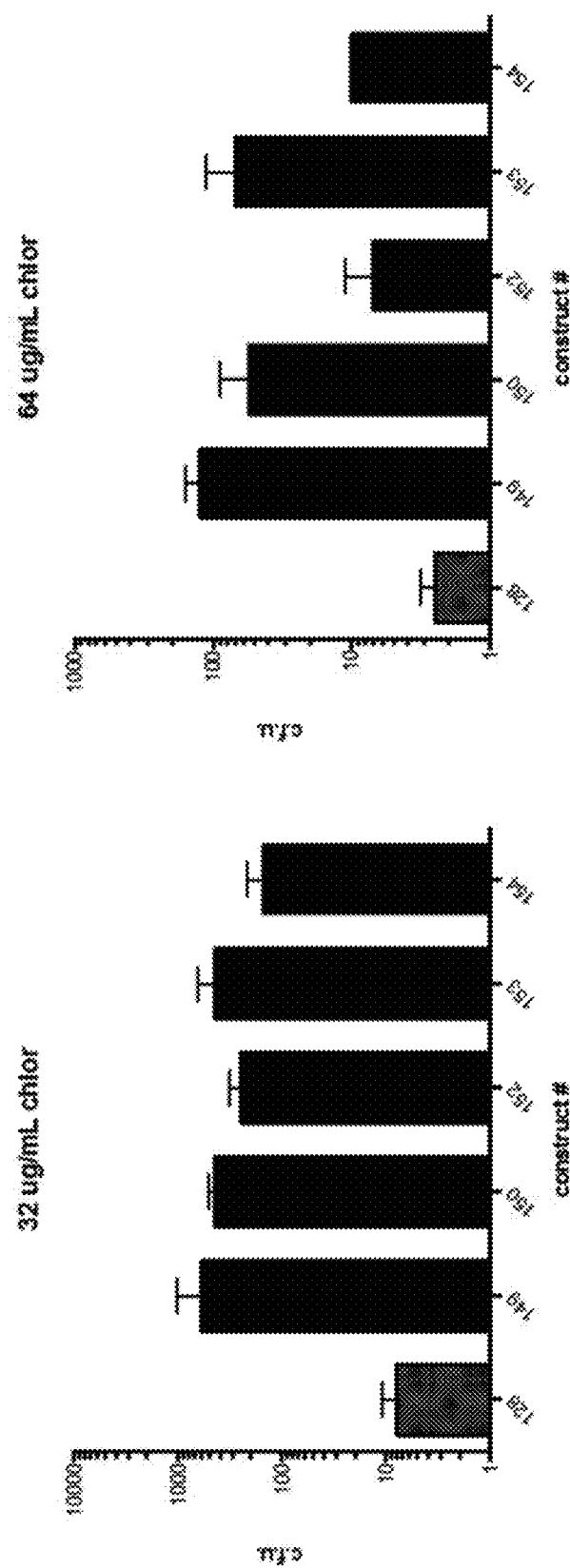
Figure 18:
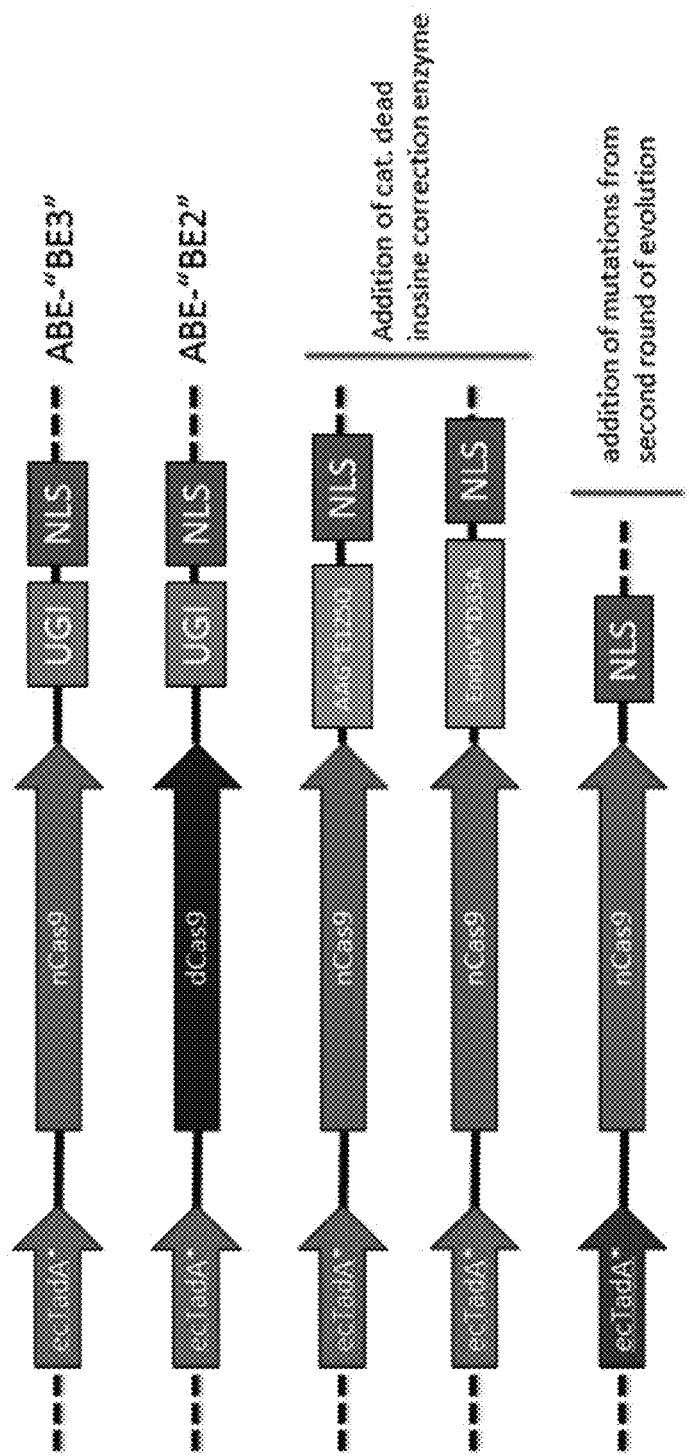
FIG. 18 show schematic representations of new constructs that were developed. New constructs include UGI, AAG*E125Q, and EndoV*D35A domains.

A second round of evolution was performed by evolving ecTadA containing a D108N mutation (see construct 3, clone 5, as listed in FIG. 11 (pNMG-128), which was identified from first round of evolution. pNMG-128 also contains mutations H8Y and N127S, which are "hitch-hiker" mutations. The evolved clones of the resulting library were challenged with 32, 64 and 128 ug/mL chloramphenicol (higher stringency than 1st round evolution of 1, 2 and 4 ug/mL). Clones which survived on 32, 64 and 128 ug/mL chloramphenicol were subcloned and re-plated, individual clones from this enrichment were isolated and assayed. The number of colony forming units (C.F.U) for each construct, pNMG-128 and pNMG 149-154, are shown in FIG. 17 under varying concentrations of chloramphenicol. A second round of evolution with high stringency conditions resulted in a high frequency of mutations at D147 and E155 of ecTadA, which are highlighted in FIG. 16.

Figure 23:
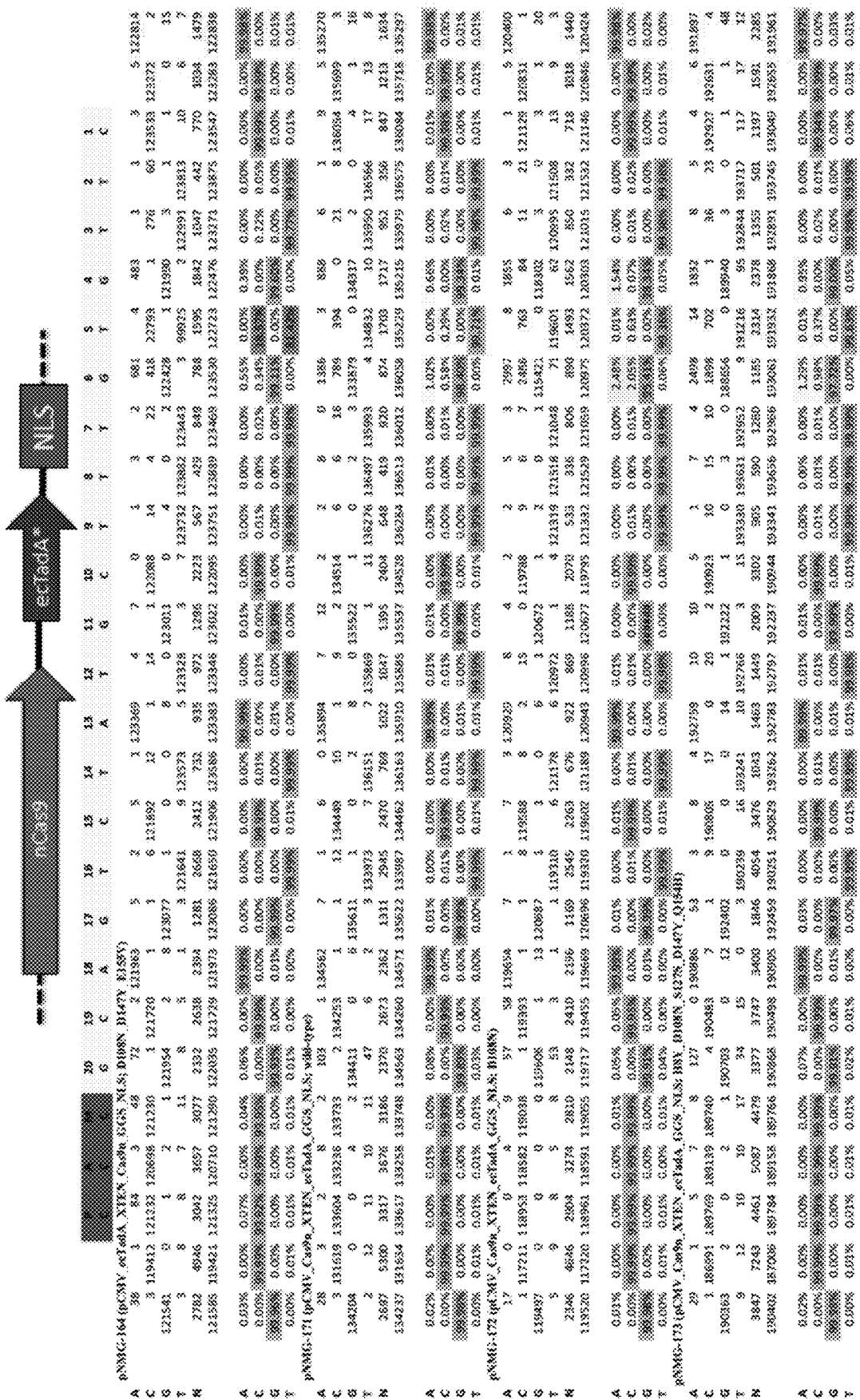
FIG. 23 shows inactive C-terminal Cas9 fusions of ecTadA for constructs pNMG-164 through pNMG-173. The sequence corresponds to SEQ ID NO: 41.
Figure 24:
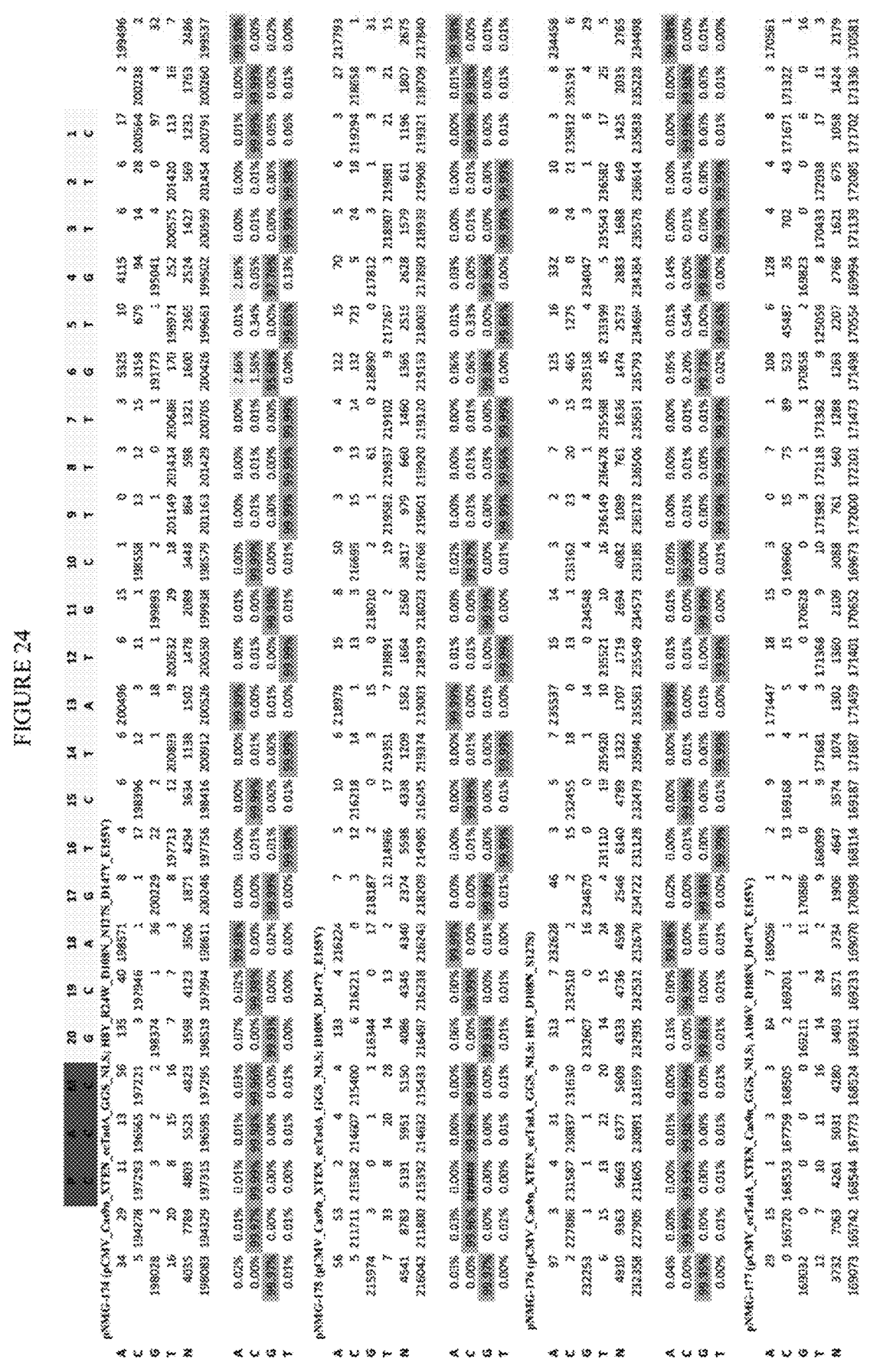
Figure 25:
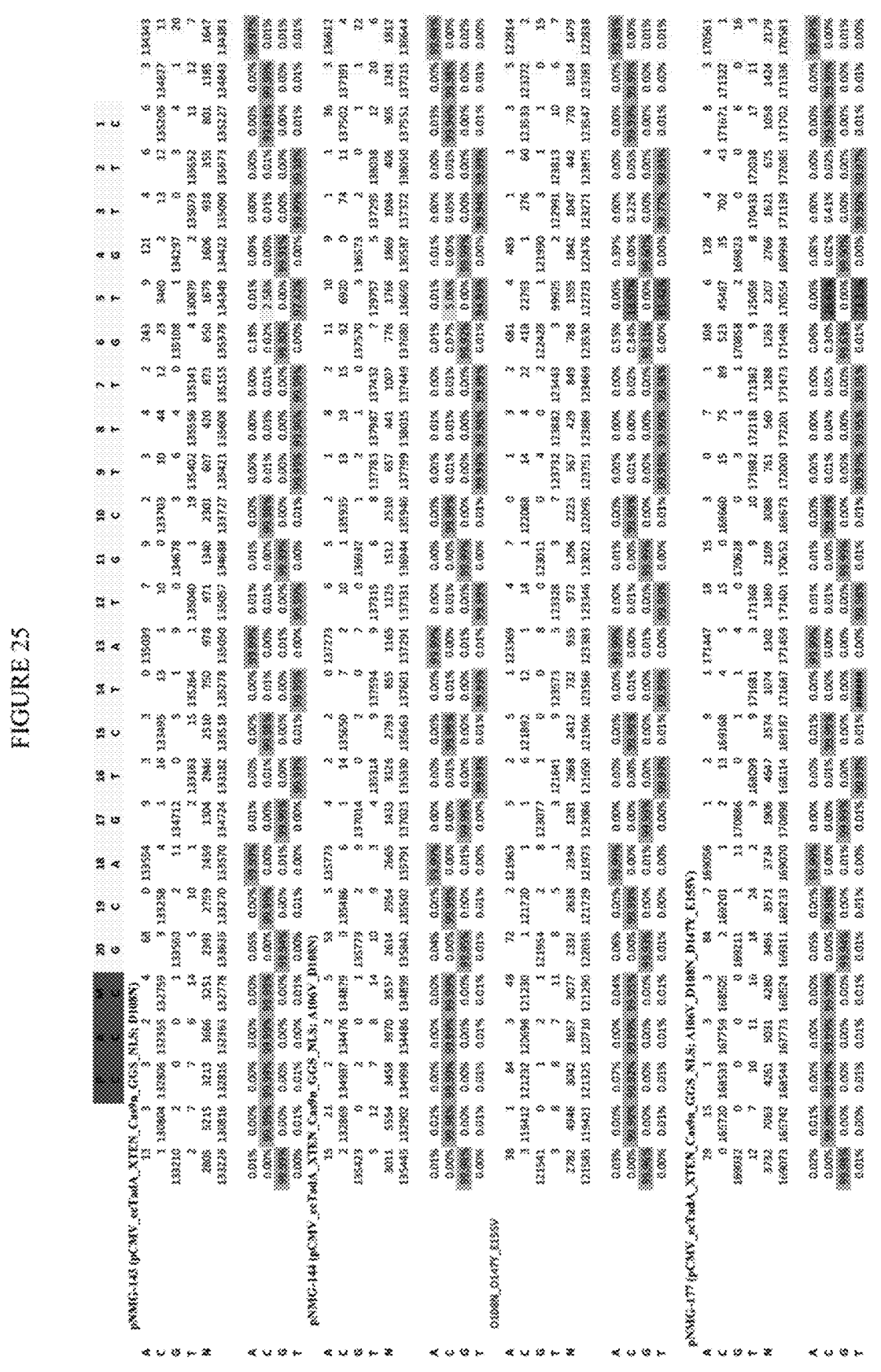
Figure 26:
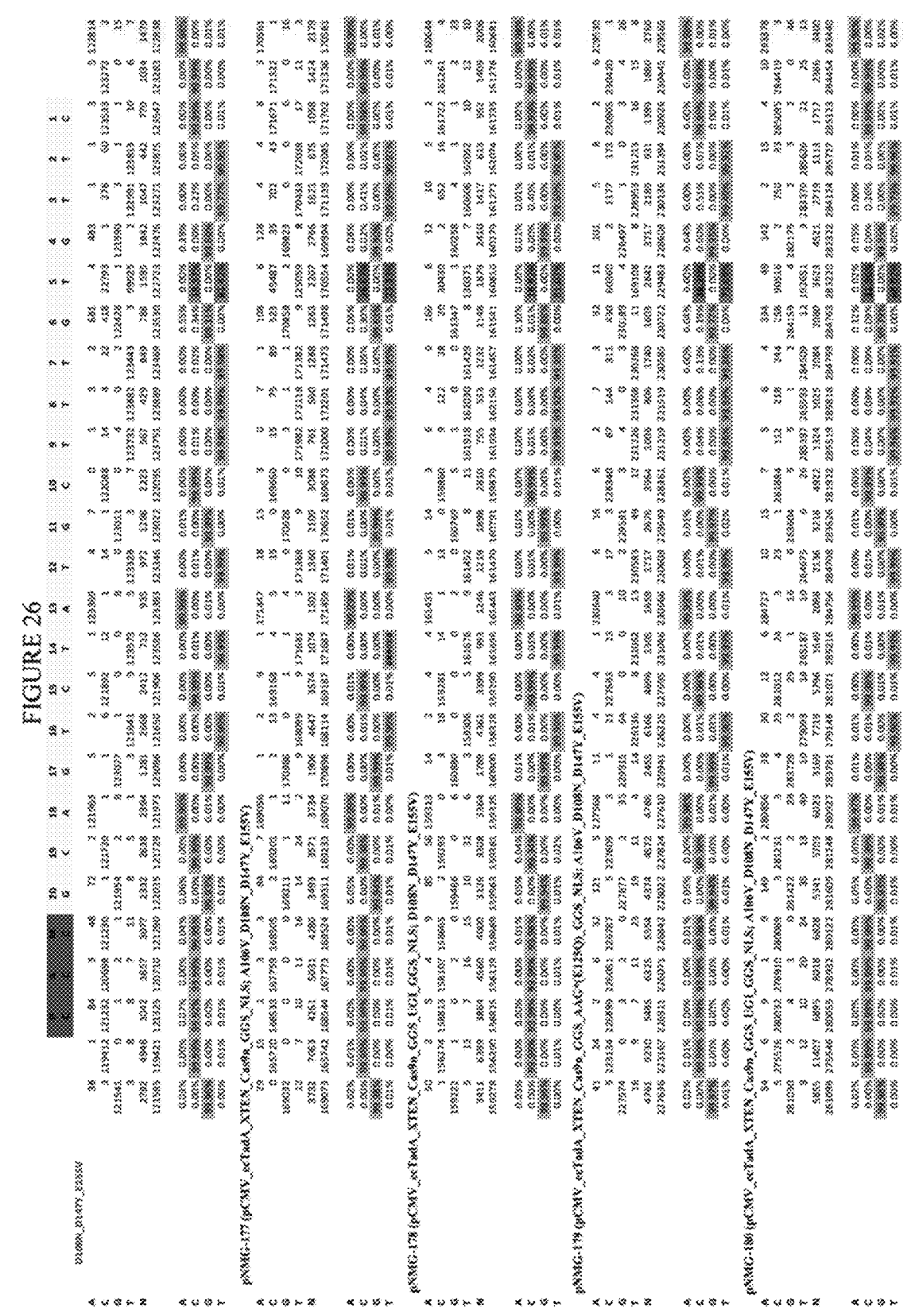
Figure 27:
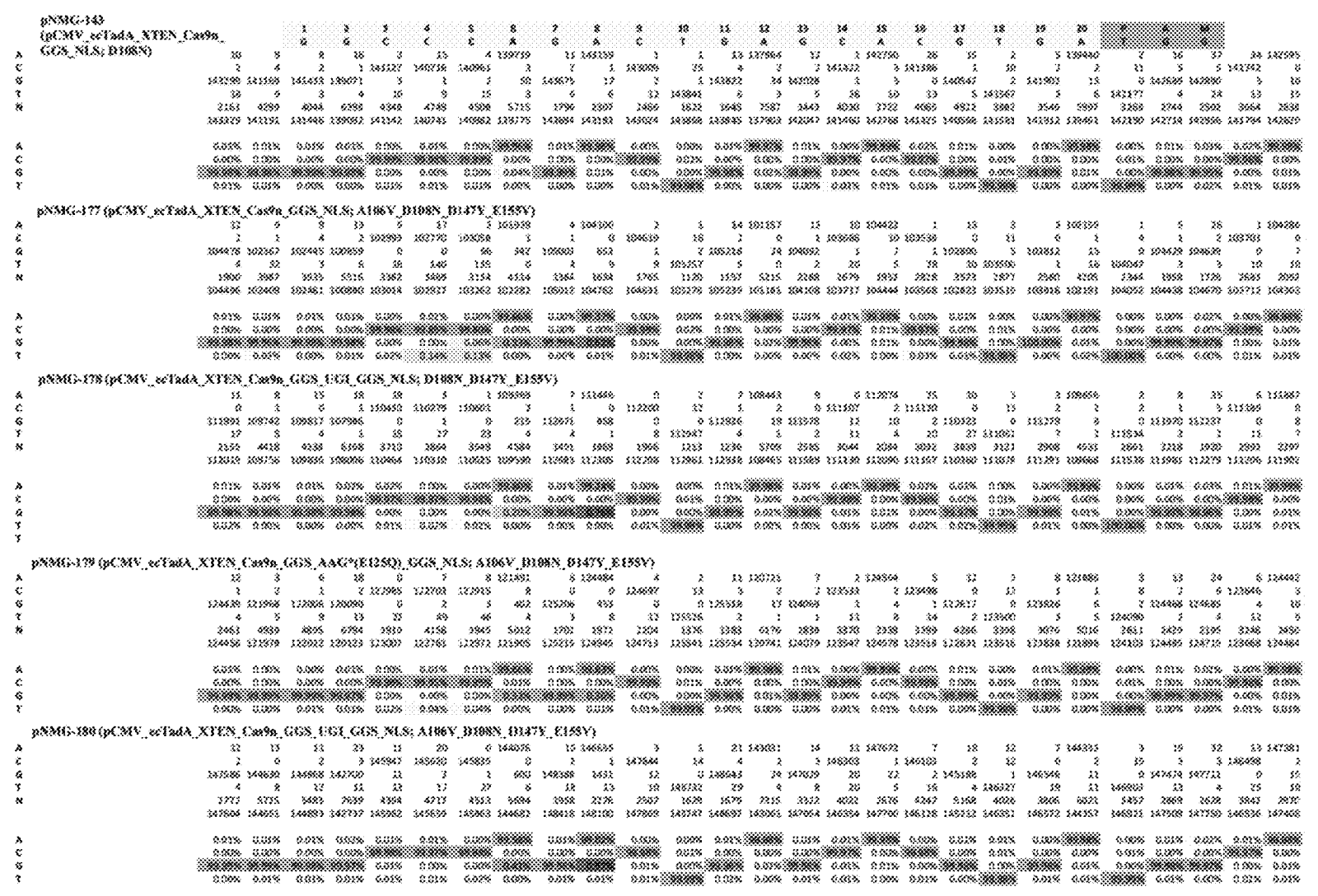

FIGS. 23-27 show the results of transfections of various ABE constusts into Hek293T cells, using a gRNA to direct the editor to the various genetic loci. FIG. 23 shows pNMG-164, 171, 172, and 173 editing on Hek-2. FIG. 24 p shows NMG-174-177 editing on Hek-2. FIG. 25 shows pNMG 143, 144, 164, 177 editing on Hek-2. FIG. 26 shows pNMG-164, pNMG-177, pNMG-178, pNMG-179, and pNMG-180 editing on Hek-2. FIG. 27 shows pNMG-164, 177-180 editing on Hek-2.

Regarding FIGS. 28-45, mammalian codon optimized constructs of ecTadA containing mutations at D108, (in some cases the mutations included the following: D108N, D108G, D108V) were used to probe whether D108 mutations identified in the first round of evolution also catalyzed A to G reversion in mammalian cells. Constructs pNMG-142-147 were transfected into Hek293T cells, and showed the greatest amount of A to G editing efficiencies at position #5 of the Hek-2 site, with low to no editing of adenines at any other sites. Exemplary DNA sequences that were targeted are described below as HEk2 (SEQ ID NO: 41), Hek3 (SEQ ID NO: 42), Hek4 (SEQ ID NO: 43), RNF2 (SEQ ID NO: 44), FANCF (SEQ ID NO: 45), and EMX1 (SEQ ID NO: 46). Subsequent experiments and evolutions have increased the editing efficiencies and identified that the editing window generally occurs at positions 4-6 in the protospacer and with a surrounding sequence of "YAC"; where "Y" is a pyrimidine (T or C) base and the underlined nucleotides, in the sequences below, is the PAM sequence. For the Hek2 sequence (SEQ ID NO: 41), shown below, the protospacer positions are indicated as 1-20 going from right to left. Position 5 of the protospacer at the Hek2 site is a T, which is opposite the A that may be edited by any of the adenosine deaminses described herein. For the Hek3, Hek4 RNF2, FANCF and EMX1 sequences (SEQ ID NOs: 42-46), shown below, the protospacer positions are indicated as 1-20 going from left to right. For these sequences one or more of the adenines (As), such as the A at position 6 of the Hek3 site (SEQ ID NO: 41), may be edited by any of the adenosine deaminses described herein. It should be noted that transfection of pNMG-142 (wild-type ecTadA fused to nCas9) produced no observable amounts of editing, underscoring the importance and necessity of implementation of the mutations arising from the directed evolution experiments.

Target sequences used in the Examples are provided below (PAM sequences are underlined in bold):

Hek2:
(SEQ ID NO: 41)
CCCGCAGTCTATGCTTTGTGTTC

Hek3:
(SEQ ID NO: 42)
GGCCCAGACTGAGCACGTGATGG

Hek4:
(SEQ ID NO: 43)
GGCACTGCGGCTGGAGGTGGGGG

RNF2:
(SEQ ID NO: 44)
GTCATCTTAGTCAGGACCTGAGG

FANCF:
(SEQ ID NO: 45)
GGAATCCCTTCTGCAGCACCTGG

EMX1:
(SEQ ID NO: 46)
GAGTCCGAGCAGAAGAAGAAGGG

Engineering Adenosine Base Editors with Domains that Inhibit Reversion of Inosine to Adenine It was hypothesized that blocking inosine reversion to adenine, for example as a result of endogenous hAAG activity, could improve base editing efficiency. Accordingly, experiments were performed to examine the effect of adding a catalytically inactive alkyl adenosine glycosylase to the C-terminal end of ABE editors. Base editor 3 (BE3) in these transfections served as the positive control for C to G base editing, pNMG-142 is the negative control, pNMG-143 is an evolution round #1 construct, pNMG-144 (D108N) is another evolution round #1 construct (A106V_D108N). The mutations in the pNMG-156 construct are all mutations identified from the highest frequency amplicons resulting from the first round of ecTadA bacterial evolution (including "hitch-hicker" mutations). Hitch-hiker mutations refer to mutations that were identified in evolution experiments, but may not have a significant effect on adenosine base editing. A method for identifying hitch-hiker mutations is to do reversion analysis and then re-assay the construct to determine whether the mutation has an effect on base editing. pNMG-156 is the mammalian codon-optimized version of pNMG-128 (the bacterial vector I isolated in the selection) with contains a C-terminal UGI. pNMG-160 is the equivalent of pNMG-143 having a catalytically inactive AAG (E125Q), pNMG-161 is pNMG-143 having a catalytically inactive Endo V (D35A). Mutations E125Q and D35A correspond to the mutations in the catalytically dead AAG and EndoV open reading frame (ORF), respectively. pNMG-162 has the same construct architecture as pNMG-156, except it does not contain UGI. The ability of these constructs to deaminate adenosine in the target sequences, HEk2 (SEQ ID NO: 41), Hek3 (SEQ ID NO: 42), Hek4 (SEQ ID NO: 43), RNF2 (SEQ ID NO: 44), FANCF (SEQ ID NO: 45), and EMX1 (SEQ ID NO: 46) is shown in FIGS. 28-33, respectively. In general, it was found that, for the constructs tested, incorporation of UGI, AAG(E125Q), or EndoV (D35A) C-terminal to the ecTadA and the Cas9 domain did not provide a significant increase in the efficiency of the base editors to generate an adenosine to guanine mutation.

Arranging the Adenosine Deaminase Domain Relative to the Cas9 Domain

Arrangement of the adenosine deaminse domain (e.g., ecTadA) relative to the Cas9 domain in adenosine base editors was tested. For example, it was tested whether placement of the adenosine deaminase N-terminal or C-terminal relative to a Cas9 domain affected base editing efficiency. Further, experiments including mutations from evolution #1 of ecTadA and evolution #2 of ecTadA were compared. See FIGS. 34-39. In general, the mutations identified in evolution #2 improved the editing efficiencies of the ABE editors identified in evolution #1. Additionally, it was found that adenosine base editors were active (mutated adenine to guanine) when the adenosine deaminase was arranged N-terminal to Cas9. Adenosine base editor constructs where the adenosine deaminase was arranged C-terminal to Cas9 showed little to no observable editing of adenine to guanine.

The following ABE constructs were transfected into Hek293T cells; pNMG-142, which served as a negative control (no mutations in ecTadA); pNMG-143 (where ecTadA has a D108N mutation), pNMG-144 (where ecTadA has a A106V, and a D108N mutation) and pNMG-164 (where ecTadA has a D108N, a D147Y, and a E155V mutation). These constructs were mammalian codon optimized constructs with mutations from evolution #1. Construct pNMG-171 served as a control for the C-terminal TadA fusion constructs of pNMG-172 to pNMG-176, which contain various ecTadA mutations. pNMG-171 contains a C-terminal wild-type ecTadA fusion to nCas9, whereas pNMG-172-176 contain mutations in TadA idenitified from evolution #1. pNMG-177 and pNMG-178 represent two mammalian codon optimized plasmids with mutations identified from evolution #2, where pNMG-178 contains a UGI domain. pNMG-179 and pNMG-180 are the same as pNMG-177 but with an added C-terminal catalytically inactive AAG (E125Q), and a UGI domain, respectively. The ability of these constructs to deaminate adenosine in the target sequences, HEk2 (SEQ ID NO: 41), Hek3 (SEQ ID NO: 42), Hek4 (SEQ ID NO: 43), RNF2 (SEQ ID NO: 44), FANCF (SEQ ID NO: 45), and EMX1 (SEQ ID NO: 46) is shown in FIGS. 34-39, respectively.

In general, it was found that fusing the adenosine deaminase (ecTadA) N-terminal to the Cas9, as opposed to C-terminal, yielded more efficient base editing of adenine. It was also found that ecTadA containing the mutations A106V, D108N, D147Y, and E155V performed better (e.g., edited adenine more efficiently) than the other ecTadA mutations tested in evolution #1 and evolution #2. Further, it was found that for the constructs tested, incorporation of UGI, or AAG(E125Q), in these constructs did not provide a significant increase in the efficiency of the base editors to generate an adenosine to guanine mutation.

Figure 40:
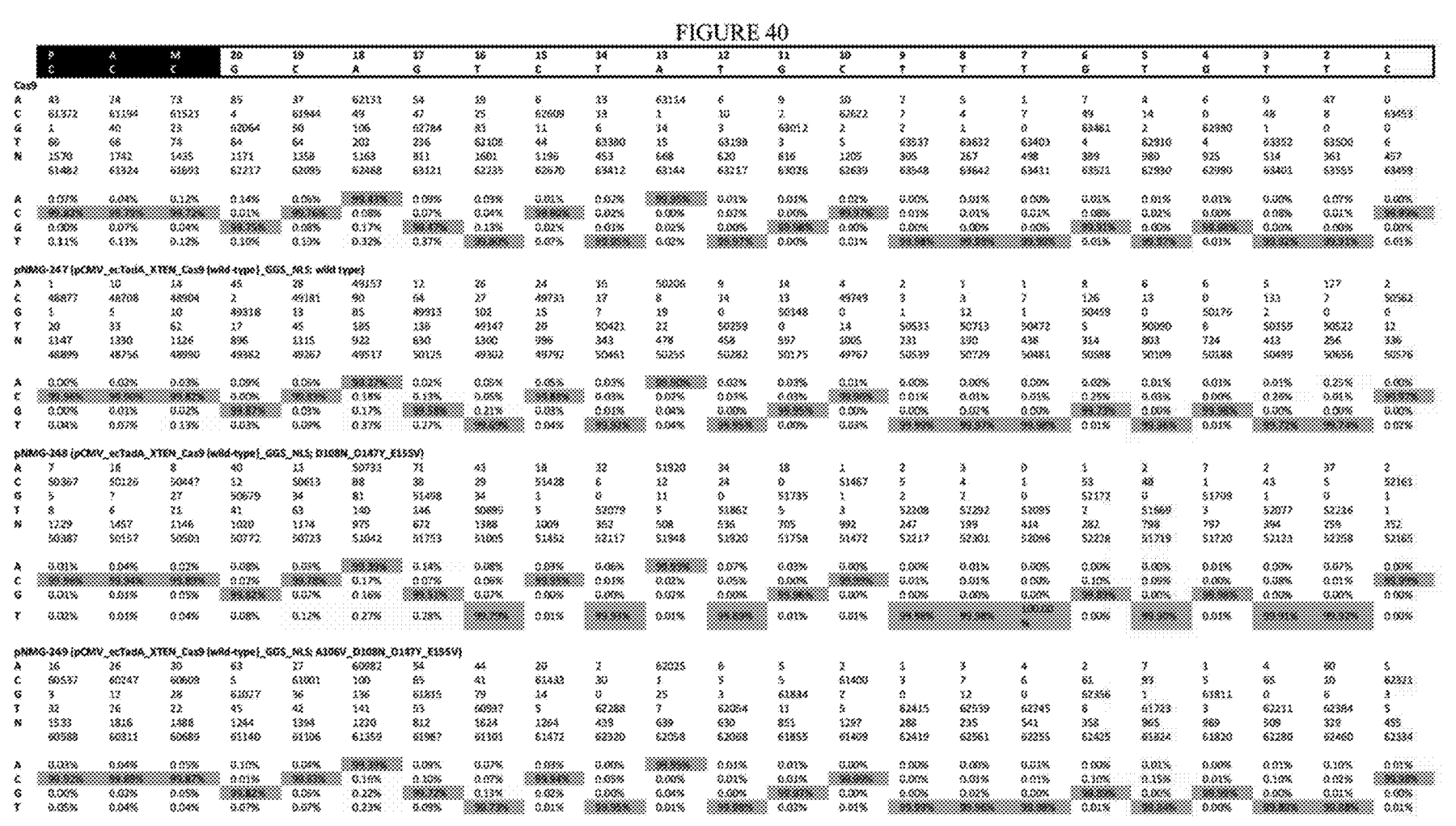
Figure 40:
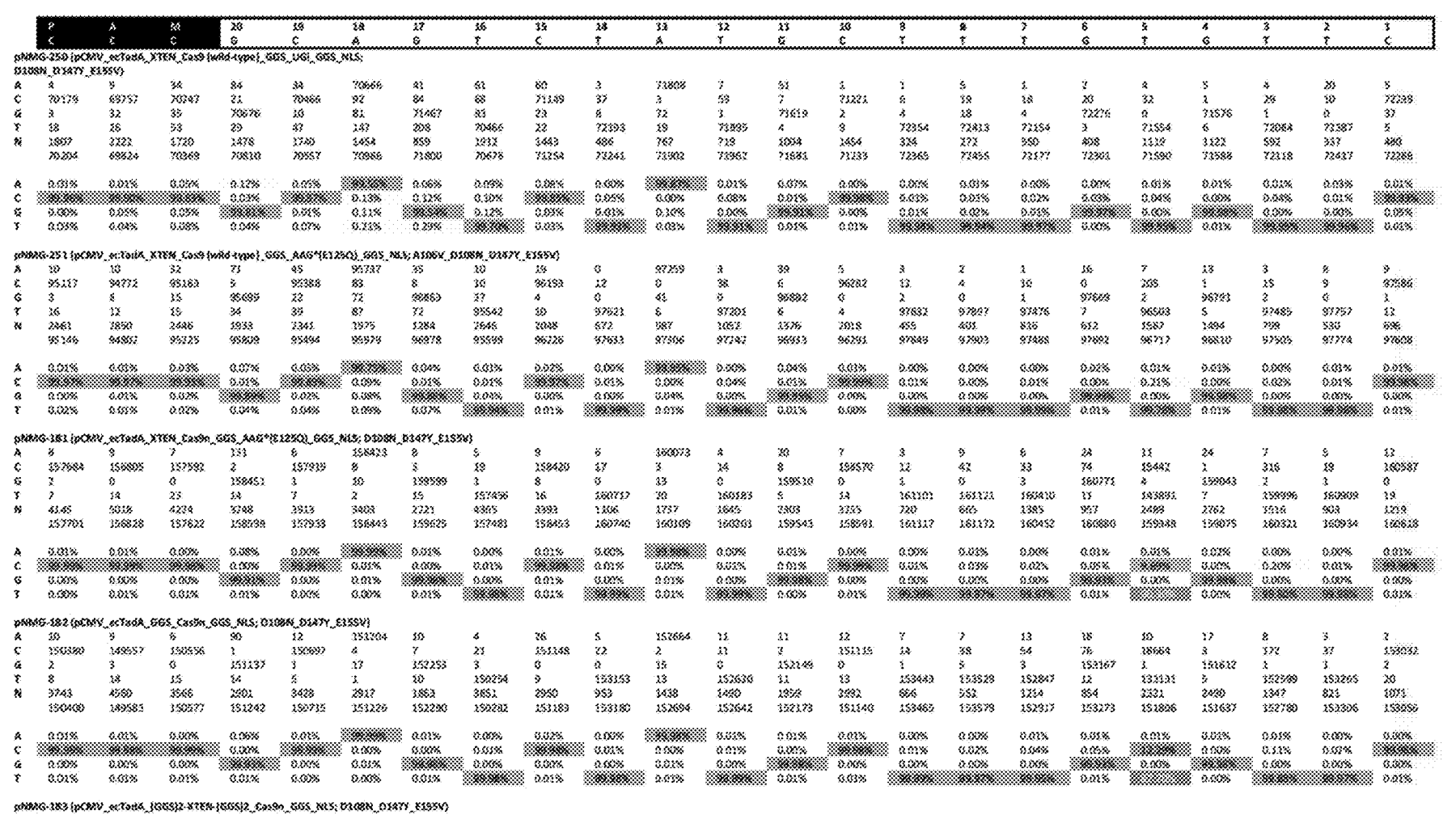
Figure 40:
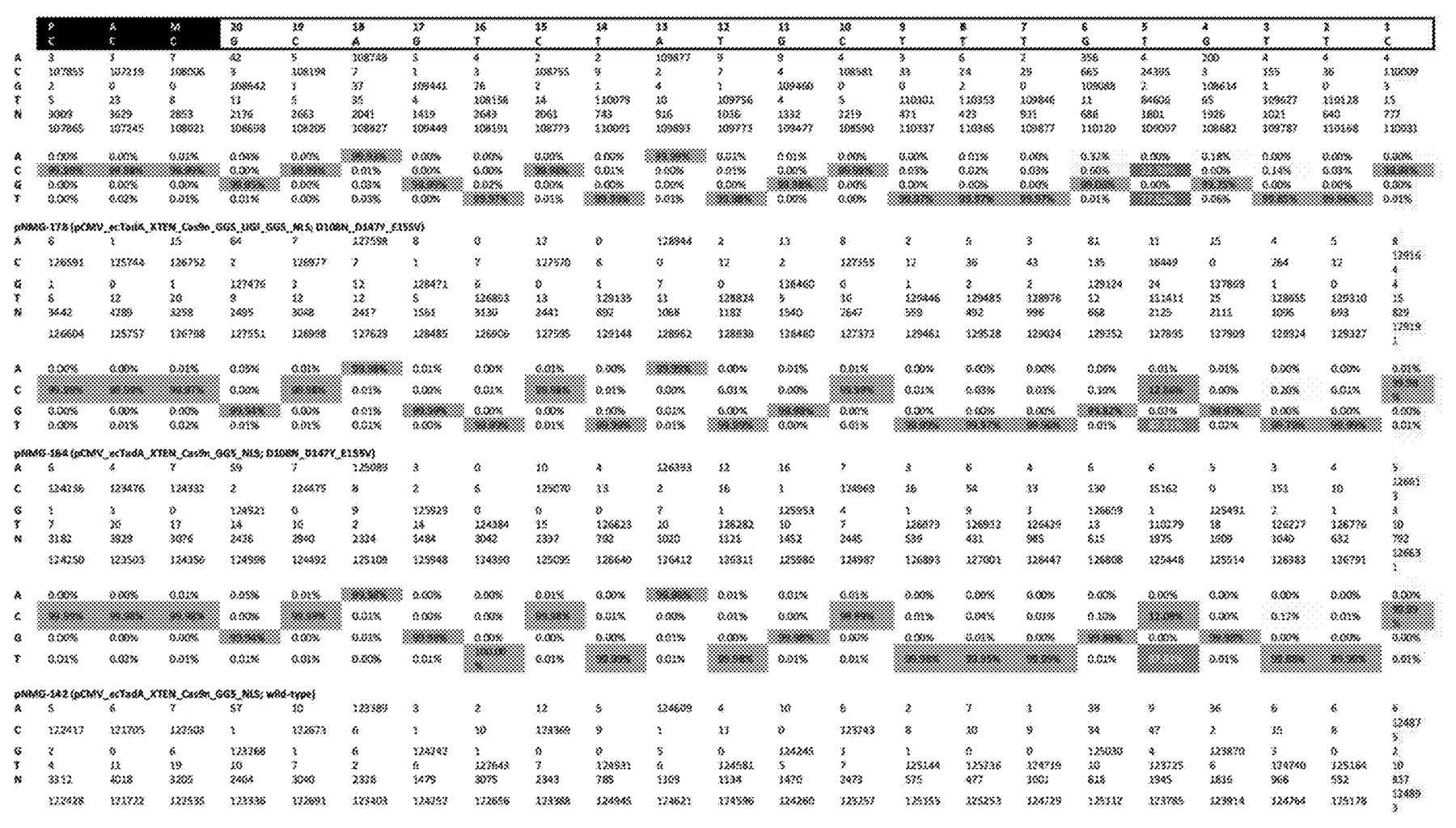
Figure 40:
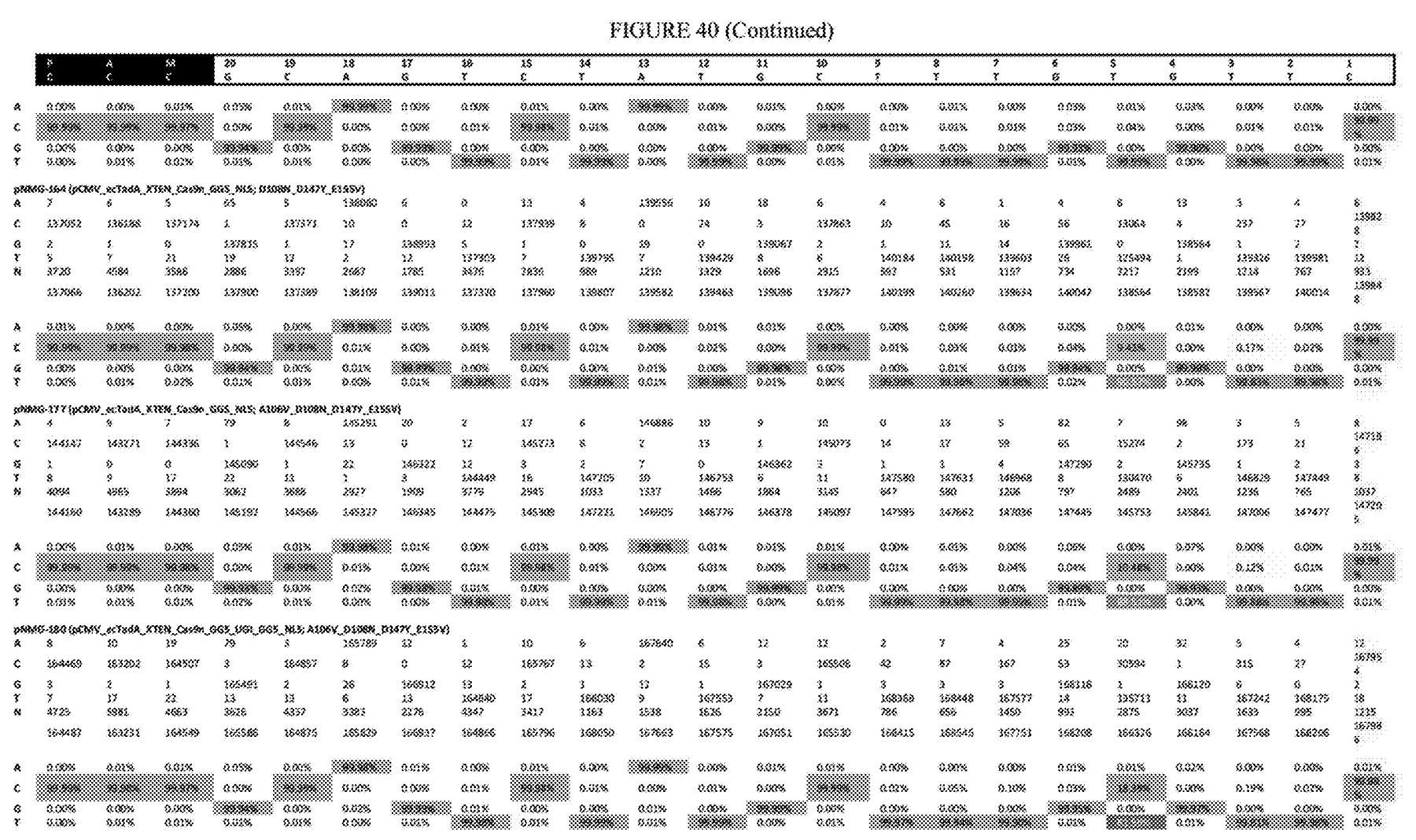
Figure 40:
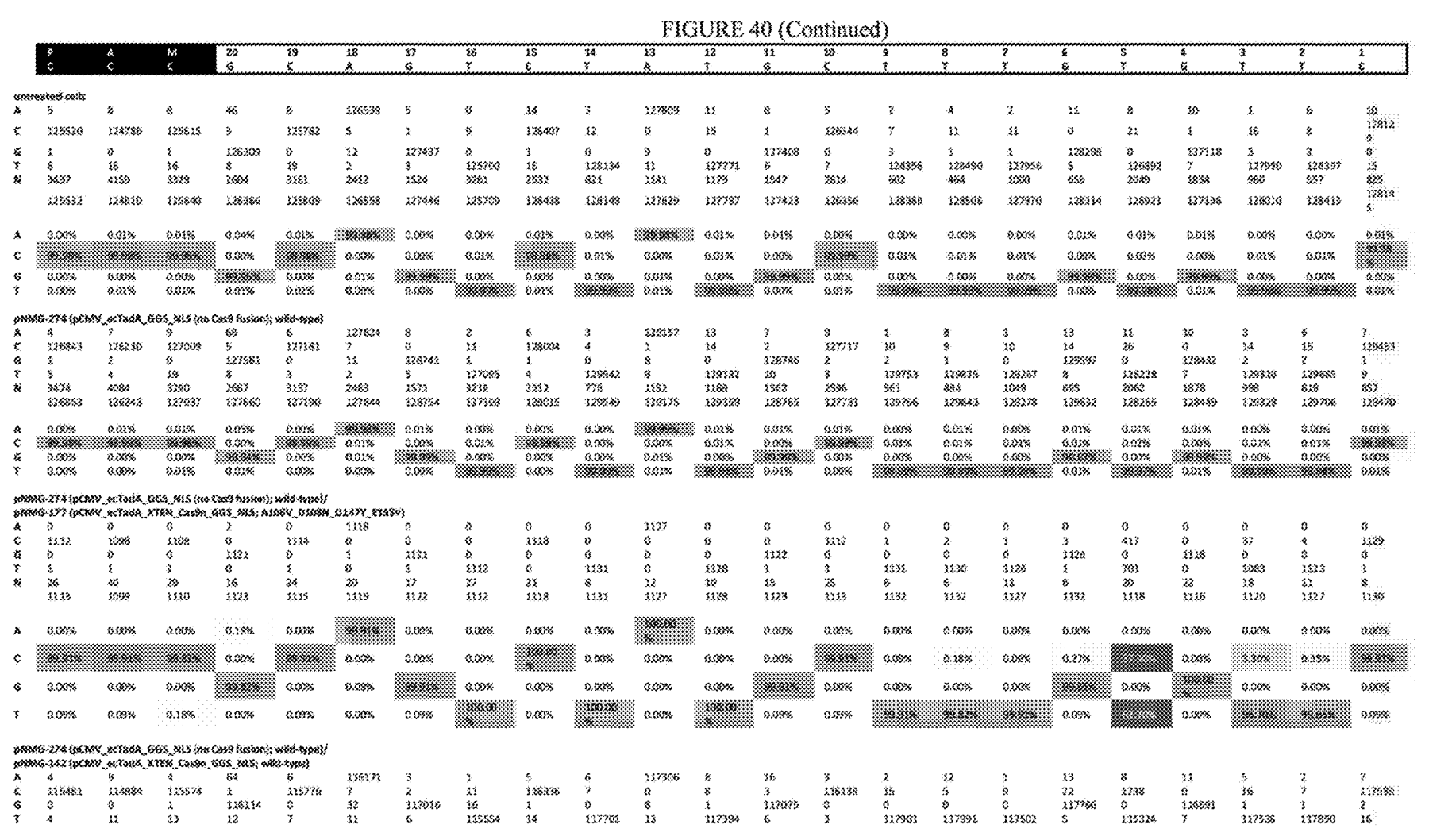
Figure 40:
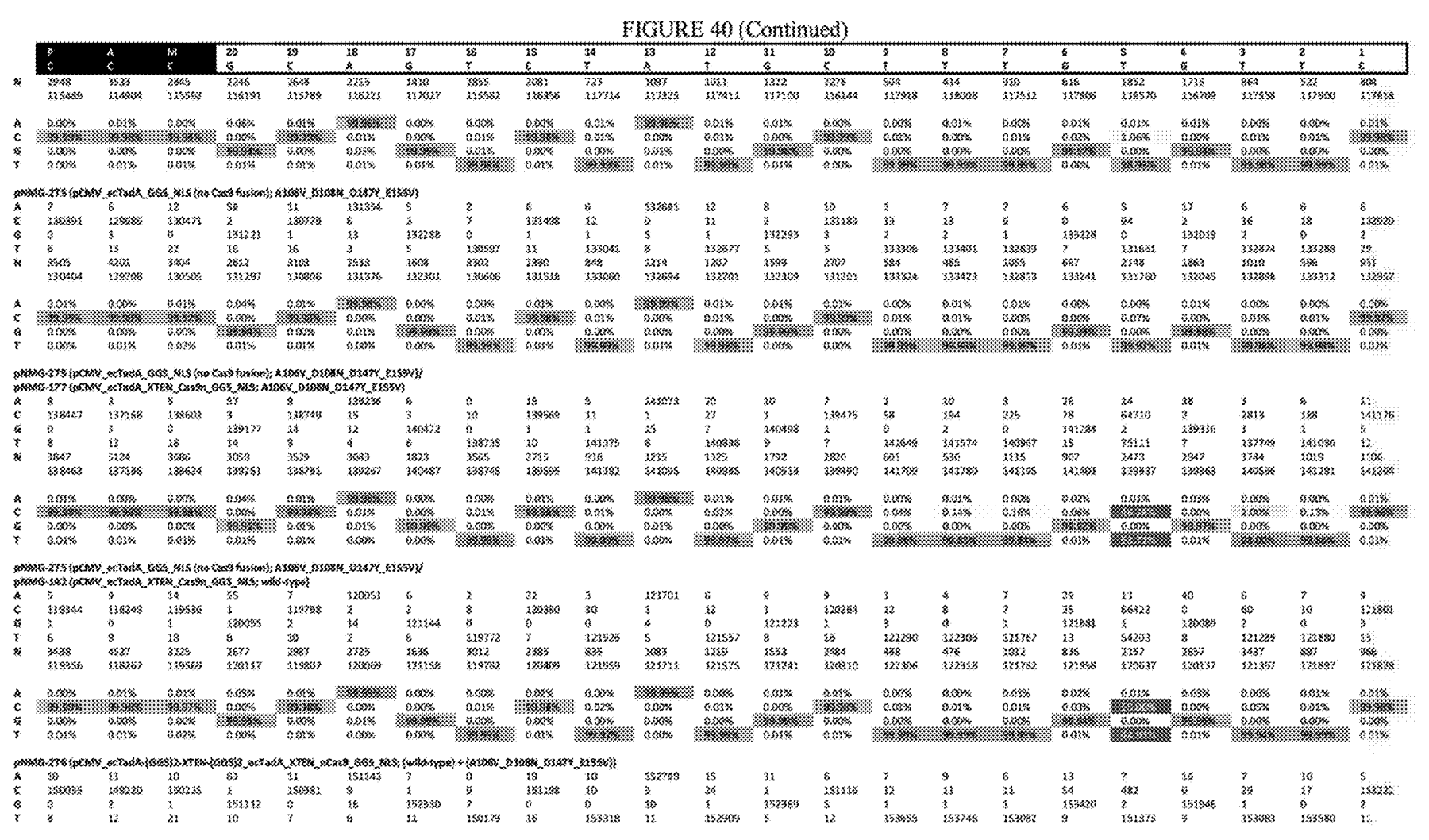
Figure 40:
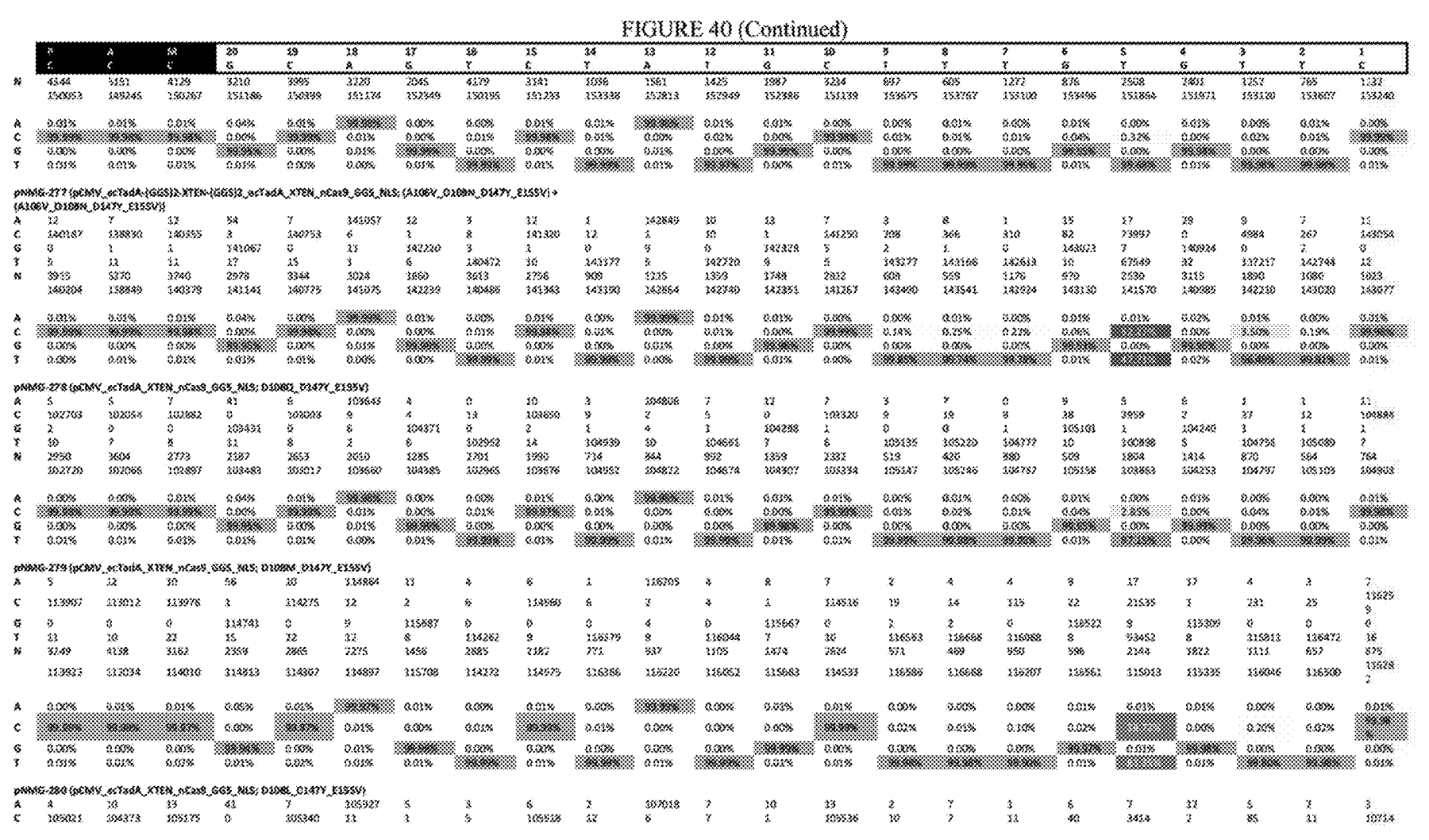
Figure 40:
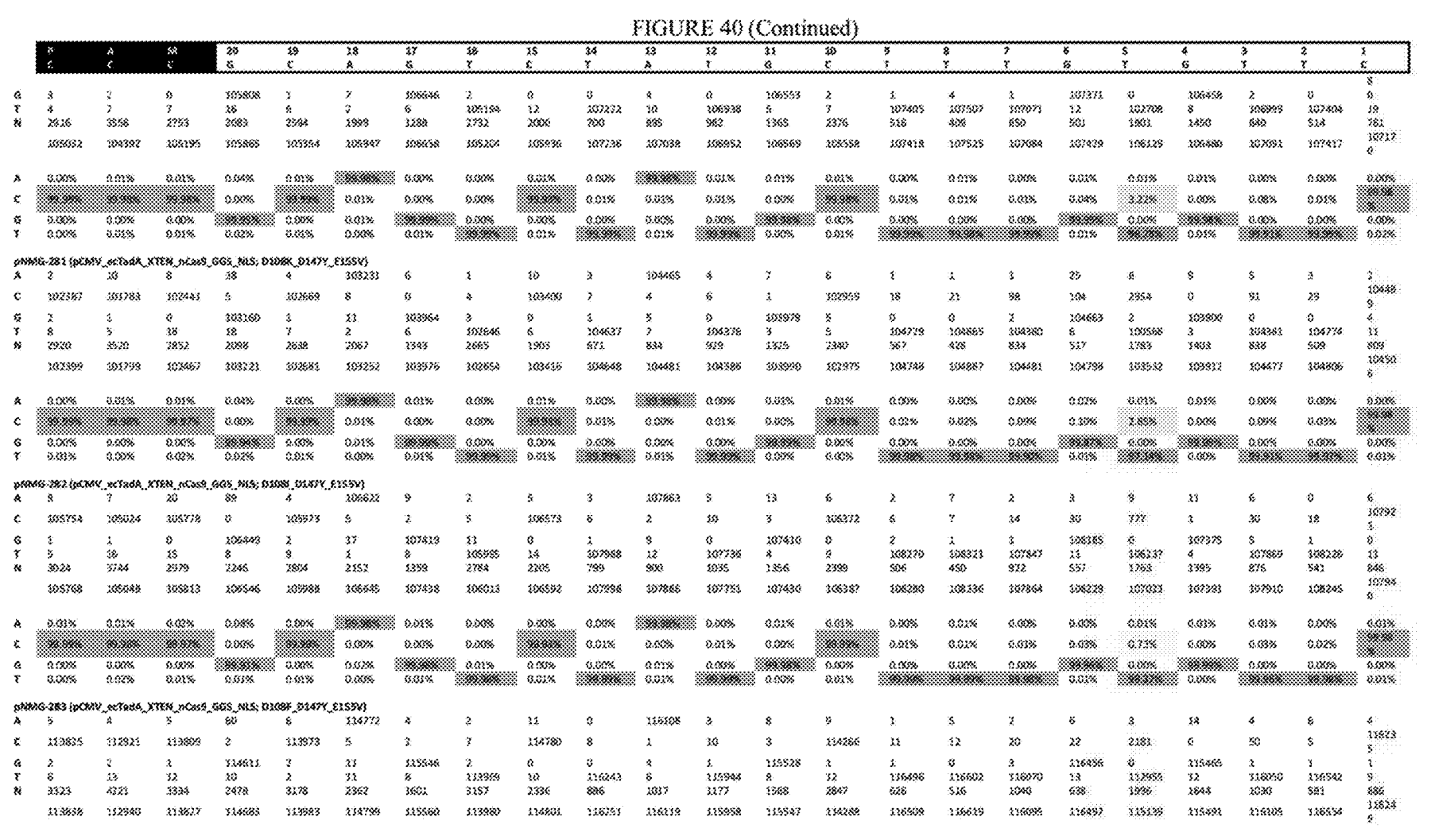
Figure 40:
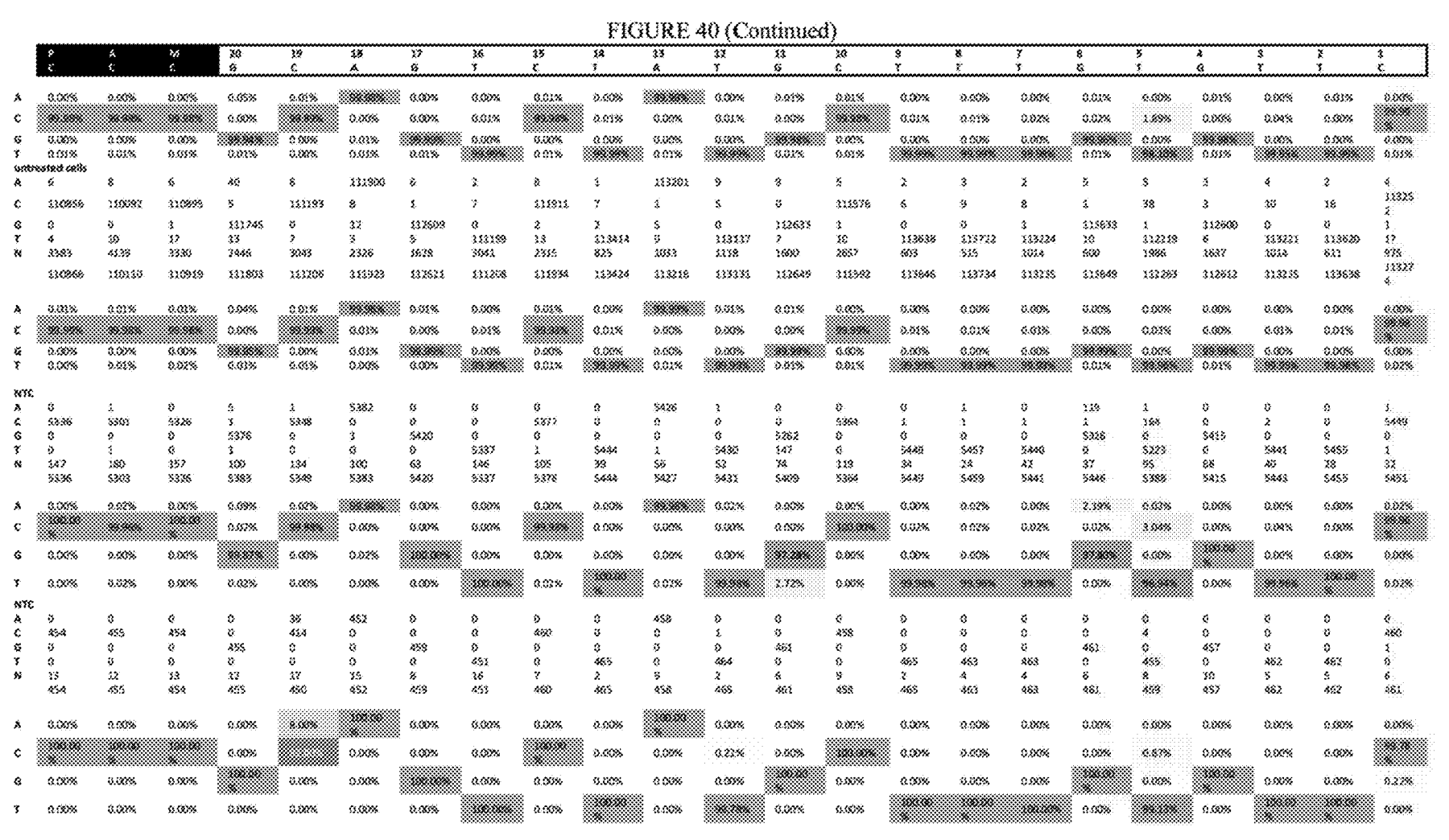

The transfection experiments shown in FIG. 40 were performed to determine four key points: One, whether ecTadA interferes with gRNA/Cas9 binding by deaminating As in the RNA of the guide. Two, whether a short linker (GGS only) or a long linker ((SGGS)$_2$-XTEN-(SGGS)$_2$) ((SGGS)$_2$) corresponds to SEQ ID NO: 2) between the evolved deaminase and Cas9 affects window size and/or overall editing efficiencies of ABE. Three, whether or not dimerization of evolved ecTadA improves ABE editing efficiencies. Four, if other substitutions at the position D108 in TadA could further enhance editing efficiencies. It was found that the ABE editors do not interfere with gRNA/Cas9 binding and that dimerization of ecTadA does improve editing efficiencies. To test whether ABE interferes with gRNA/Cas9 binding nCas9 was replaced with wild-type Cas9 in various evolved ABE constructs (pNMG-247-251) and compared INDEL rates to Cas9 (wt) only INDEL rates (see FIG. 48). A to G editing efficiencies are undetectable in FIG. 40 for pNMG-247-251, likely due to wild-type Cas9 nuclease activity. It was also determined that the long linker between the evolved ecTadA and nCas9 (pNMG-183) yielded higher editing efficiencies relative to XTEN only and GGS only linkers. Most strikingly, dimerization of the ecTadA unit of ABE was tested both in trans by co-transfecting equimolar amounts of ecTadA (with and without mutations from evolution) with ABE editors pNMG-142 (neg control), pNMG-177 (A106V_D108N_D147Y_E155V) and in cis by making editors in which two units of ecTadA were covalently tethered (with a (SGGS)$_2$-XTEN-(SGGS)$_2$ linker). Monomeric units used for in trans dimerization experiments are pNMG-274 and pNMG-275. Covalent fusions of two units of ecTadA in the ABE editor are represented in pNMG-276 (negative control, two units of wild-type TadA in the ABE editor) and pNMG-277. Lastly, transfections with plasmids pNMG-278-283, which represent ABE editors that have varying mutations at D108 position in ecTadA (e.g. D108M, D108Q, D108K, etc), showed that the D108N substitution originally identified in round #1 evolution is the best performing mutation at this position.

Example 3—Development of Adenosine Base Editors (Evolution #3)

An ecTadA construct with the consensus mutations A106V, D108N, D147Y (pNMG-184) and E155V was mutagenized with error-pone PCR and the resulting ABE library was targeted with 2 separate gRNAs to two different sites in a kanamycin resistance gene which require two A to G reversions (both in premature stop codons) to conder kanamycin resistance. The 2 gRNA/2 target approach was used to increase the stringency of the selection. This evolution resulted in the identification of the following new mutations: L84F, H123Y and I157F.
Deaminase Editing sgRNA During the development of ABE, it was questioned whether or not the deaminase was editing the sgRNA and did TadA still have RNA activity. Based on the results shown in FIG. 48, fusions appeared to bind well, but there was no significant difference between ABE and Cas9 indel percentage. This demonstrates that ABE is not interfering or modifying the gRNA strand. Differences between wt Cas9 only and ABE fused to wild-type Cas9 would suggest deaminase interference with the gRNA. This was not the case.

Figures 50, 51, 52:
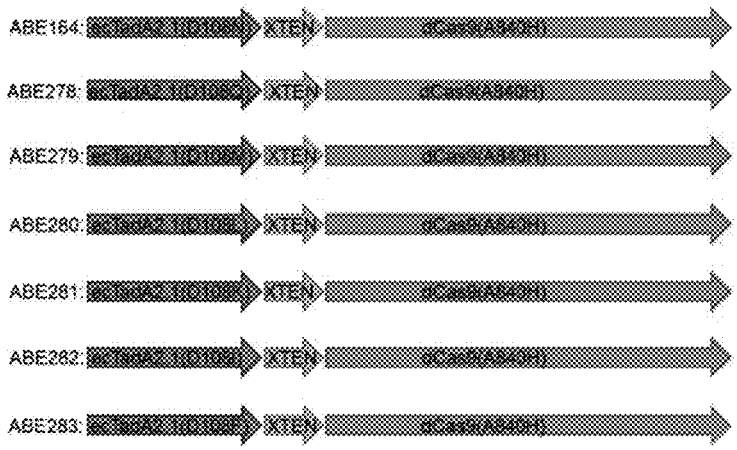
FIG. 50 shows constructs developed for fusions at various sites using further mutated D108 residue.
FIG. 51 shows the protospacer and PAM sequences of base editing sites set forth in SEQ ID NOs: 6, 46, and 42 from top to bottom, respectively.
FIG. 52 shows the results of using mutated D108 residues to cause deaminase to reject RNA as a substrate and change the editing outcome.
Figures 53, 54, 55:
FIG. 53 shows the results of using mutated D108 residues to cause deaminase to reject RNA as a substrate and change the editing outcome.
FIG. 54 shows constructs developed for fusions at various sites.
FIG. 55 shows the protospacer and PAM sequences of base editing sites set forth in SEQ ID NOs: 6, 358, 359 from top to bottom, respectively.

It was also questioned whether or not D108 residue could be further mutated to cause deaminase to reject RNA as a substrate. The sgRNAs encoding sites can be found in FIG. 51. Results have shown that a D108M mutation in ecTadA does not significantly improve editing efficiency of the adenosine base editors.

It was found that tethering an additional unit of the mutant TadA to the ABE results in higher editing efficiencies for deamination of the DNA. Tethering an AAG, a base excision repair enzyme, to ABE did not significantly enhance base editing. Tethering catalytically inactivated EndoV, the *E. Coli* DNA repair enzyme, to ABE also did not significantly enhance base editing. Furthermore, knock-out cell lines of AAG (which revert inosine back to A) had no better editing efficiencies than the parent strain.

Figures 56, 57, 58:
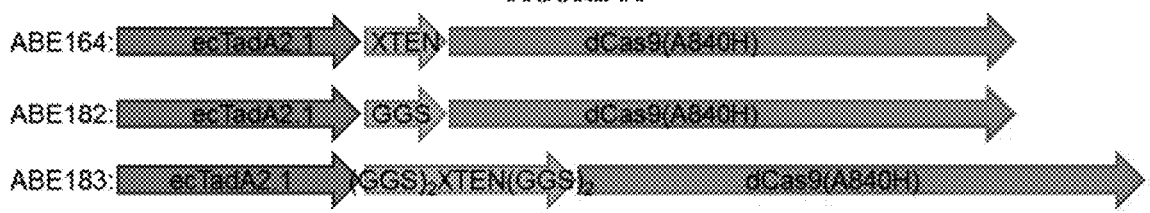
FIG. 56 shows the results of ABE on HEK site 2.
FIG. 57 shows the results of ABE on HEK site 2.
FIG. 58 shows constructs developed for fusions at various sites using various linker lengths.
Figure 61:
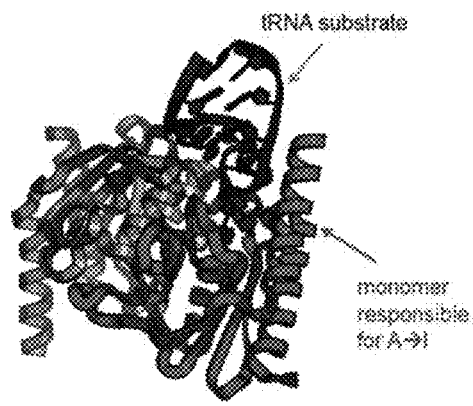
FIG. 61 is a schematic showing the dimerization of deaminase.
Figure 62:
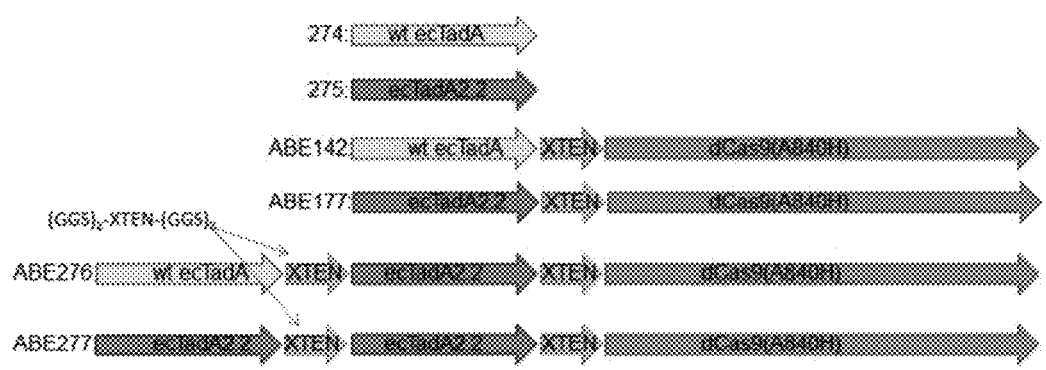
FIG. 62 shows constructs developed for fusions at various sites using various linker lengths.

A next goal was to determine why ABE edit more efficiently on the HEK site 2 than on other sites tested. While adenosine base editors worked well at all sites, they worked optimally at the Hek-2 site. It was theorized that ABE worked best on HEK site 2 due to an abundance of adenine residues. Results shown in FIG. 57 show that this is not the case. Another theory was that linker length could be why ABE only worked on the HEK site 2. Results shown in FIG. 59 and FIG. 60 proved inconclusive. The longest linker to Cas9 between ecTadA and Cas9 enhanced editing efficiencies but did not seem to expand the base editing window. It was also tested whether an ABE efficiently edited Hek-2 similar sites and it was found that there was very efficient editing at Held-2 similar sites. From this data it was found that the ABEs edited adenines more efficiently when they were part of a "YAC" consensus sequence, where Y is C or T. Also, the tRNA substrate of ecTadA is in the context of "U-A-C" which is YAC.

Figure 63:
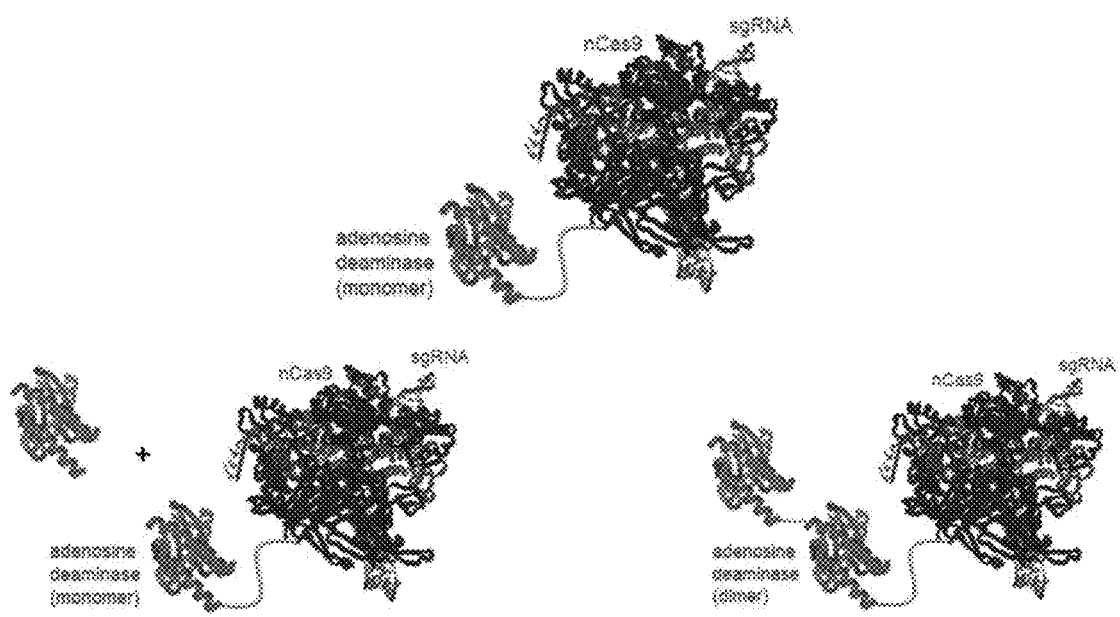
FIG. 63 shows the current editor architecture (top panel), the in trans dimerization (bottom panel, left), and the in cis dimerization (bottom panel, right).
Figures 64, 65:
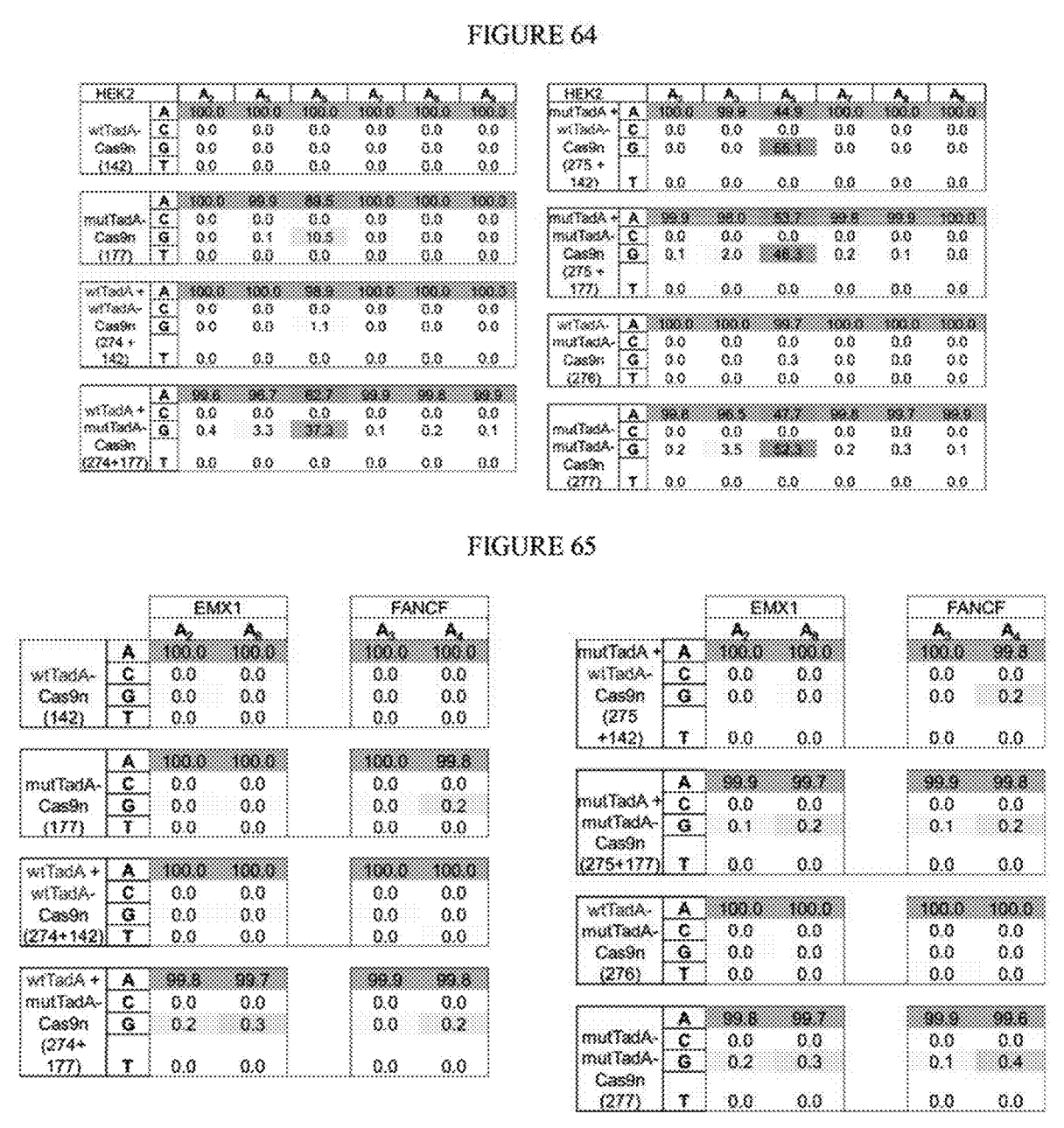
Figures 66, 67:
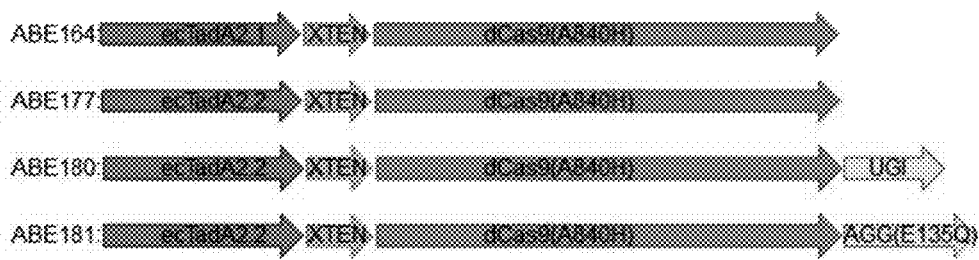
FIG. 66 shows dimerization results from base editing.
FIG. 67 shows constructs developed for fusions at various sgRNA sites.
Figure 68:
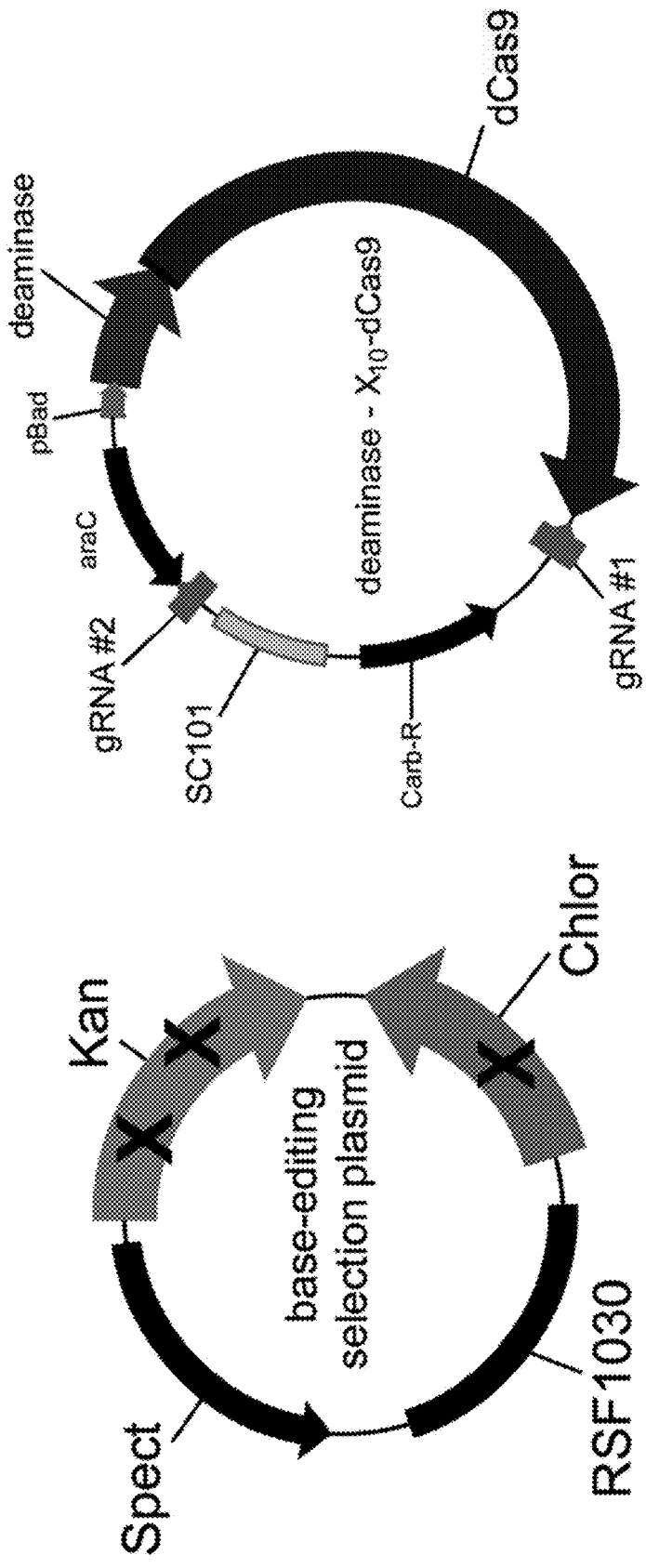
FIG. 68 shows the evolution of ABE editor against new selection sequences. The sequences from top to bottom and left to right correspond to SEQ ID NOs: 707-719, respectively.
Figure 79:
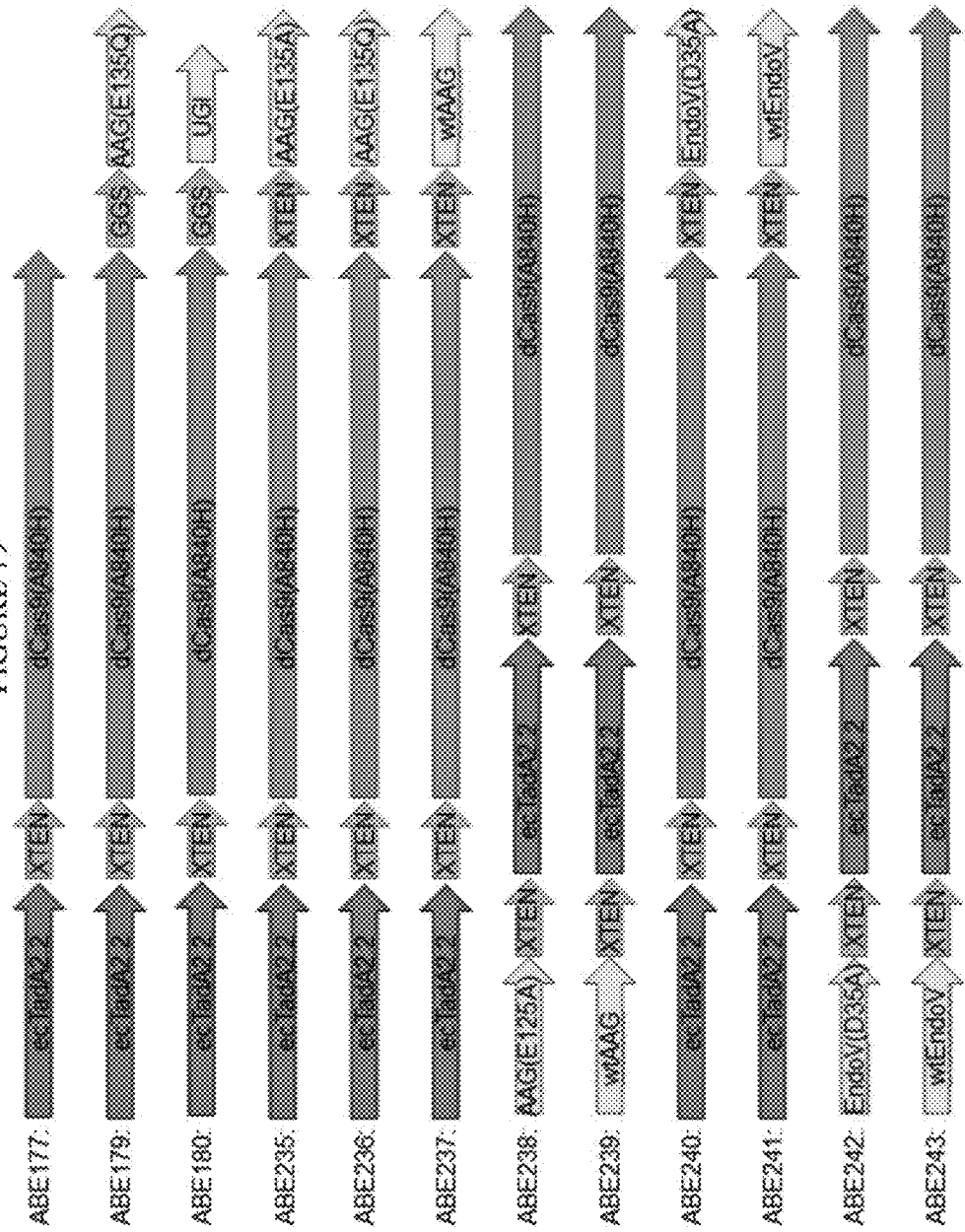
FIG. 79 shows the constructs of all inhibitors tested.
Figure 80:
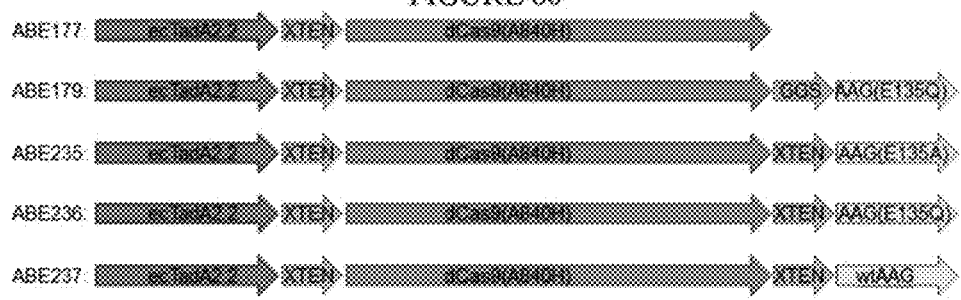
FIG. 80 shows the constructs used when tethering AAG to ABE.
Figure 81:
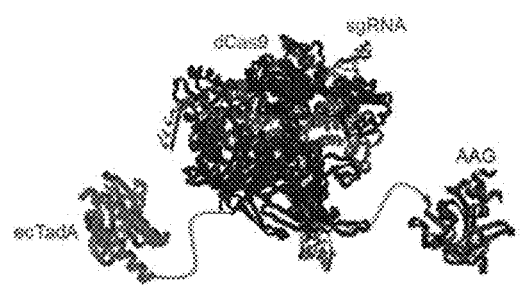
FIG. 81 is a schematic showing the tethering of AAG to ABE.
Figures 82, 83:
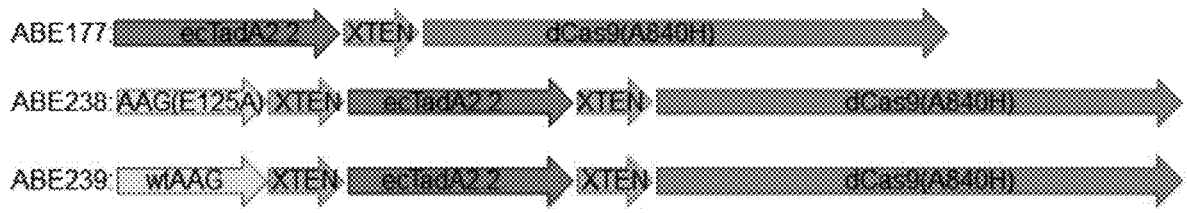
FIG. 82 shows the results of tethering AAG to ABE.
FIG. 83 shows the constructs used when tethering AAG to ABE with an N-terminus of TadA.
Figures 84, 85:
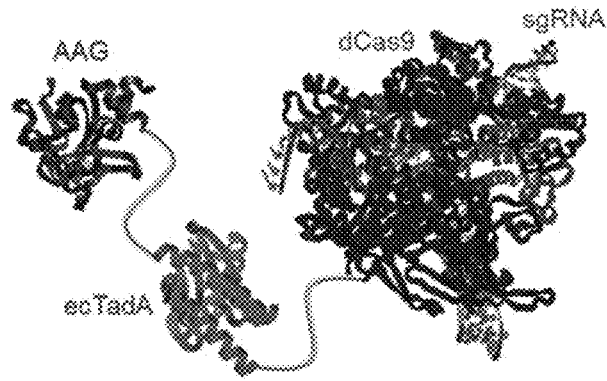
FIG. 84 is a schematic showing the tethering of AAG to ABE with an N-terminus of TadA.
FIG. 85 shows the results of tethering AAG to ABE.
Figure 91:
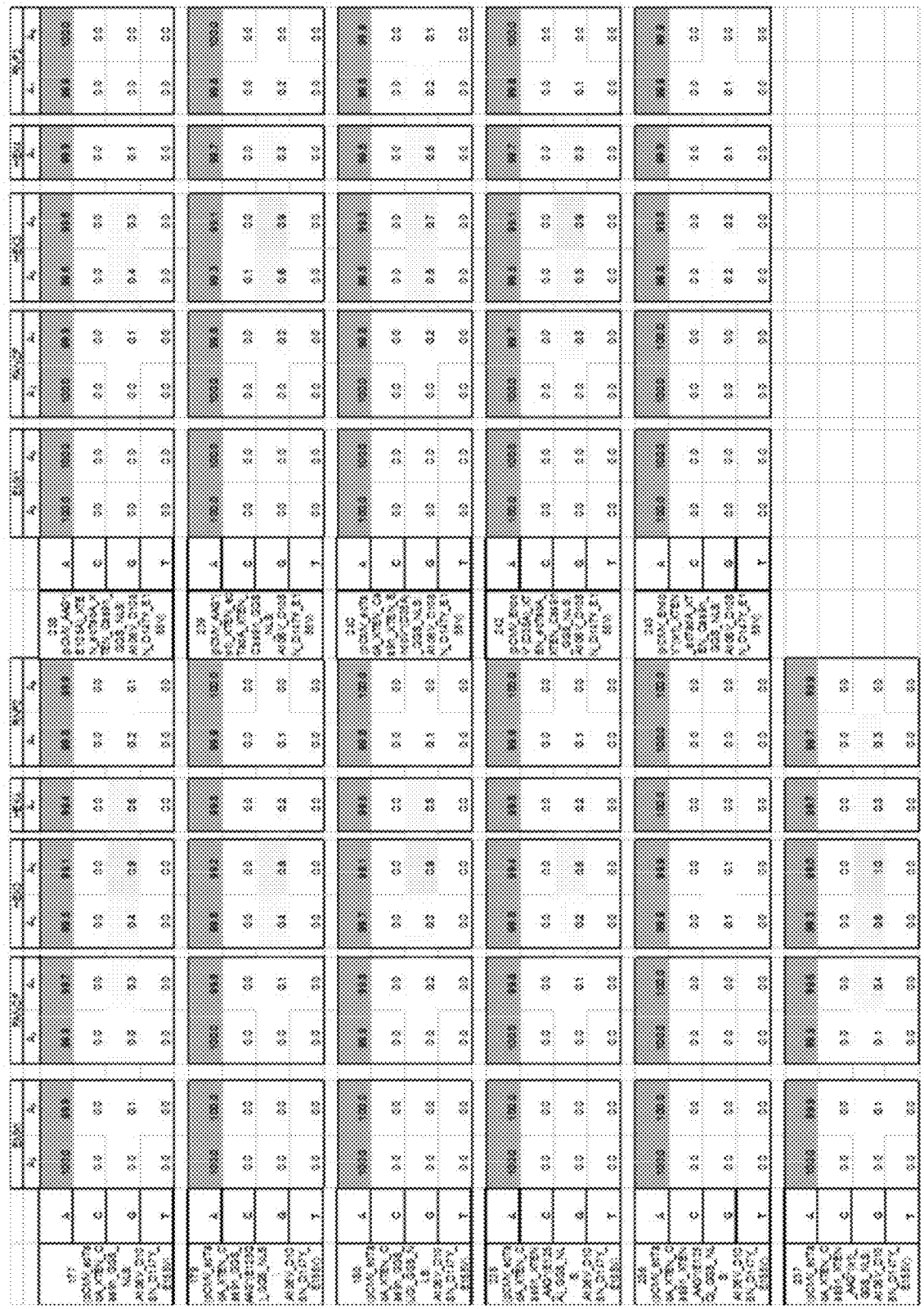
FIG. 91 shows the results of various inhibitors increasing A to G editing.

It has been suggested that dimerization of the deaminase may improve base editing. The current editor architecture, in trans dimerization, and in cis dimerization are shown in FIG. 63 (top structure, bottom left structure, and bottom right structure). Results shown in FIG. 64 through FIG. 66 show that dimerization of the deaminase improved base editing. With respect to the "YAC" sequence specificity, one hypothesis, supported by the data, is that ABE operates best on As in positions 4-6 of the protospacer and with a surrounding sequence of "YAC"; target A underlined, where Y is C or T.
Evolving ABE Editor Against New Selection Sequences A next goal was to modify the ABE editor sequence preferences. One ABE targeted the Q4 stop site only and A to G reversion was observed, as shown in FIG. 69. Results also showed that the editor targeted the W15 stop site only and A to G reversion was observed, as shown in FIG. 70. Sequences were different than original evolution target, which was the chloramphenicol active site. New mutations could result in a kinetically faster enzyme. The third round of evolution targeted both Q4 and W15 sites simultaneously in the kanamycin gene. Correction of two sites in the same gene, in addition to targeting sites of with sequence identity dissimilar from the original chloramphenicol gene creates greater selection stringency. The template used for evolution #3 was bacterial plasmid pNMG-288 which contained 2gRNA (targeting Q4 stop and W15 stop in kanamycin). Error-pone PCR was performed on the deaminase portion of pNMG-288 which already contained the following mutations: A106V, D108N, D147Y, E155V.

Upon creating mammalian constructs of the corresponding variants resulting from evolution round #3, it was found that pNMG-341 and pNMG-340 generally out-performed pNMG-290, which was the most highly optimized construct from evolution #2.

TABLE 5

Includes exemplary protospacer and PAM sequences. An RNA sequence complementary to the protospacer sequence in the table would be used in a gRNA to target an ABE to the sequence. The target A with respect to the original Hek-2 site (originally at position 5) is shown in bold, and nucleotides that differ from the original Hek-2 sequence are underlined. The sequences correspond to SEQ ID NOs: 445-464 from top to bottom.

| plasmid name | comment | protospacer sequence | PAM |
|---|---|---|---|
| pNMG-299 | other sites within HEK2 locus | GAACACAAAGCATAGACTGC | GGG |
| pNMG-301 | other sites within HEK2 locus | GGAACACAAAGCATAGACTG | CGG |
| pNMG-302 | other sites within HEK2 locus | AACACAAAGCATAGACTGCG | GGG |
| pNMG-303 | other sites within HEK2 locus | ACAAAGCATAGACTGCGGGG | CGG |
| pNMG-304 | other sites within HEK2 locus | CAAAGCATAGACTGCGGGGC | GGG |
| pNMG-305 | other sites within HEK2 locus | GTGGTAATTTTCCAGCCCGC | TGG |
| pNMG-306 | other sites within HEK2 locus | CCTTTACAGGGCCAGCGGGC | TGG |
| pNMG-307 | other sites within HEK2 locus | CTGTCACAGTTAGCTCAGCC | AGG |
| pNMG-308 | other sites within HEK2 locus | GTGTTCCAGTTTCCTTTACA | GGG |
| pNMG-300 | Hek-2 guideSEQ off-target | GAACACAATGCATAGATTGC | CGG |
| pNMG-309 | Hek-2 similar site | GAAAAAAAGCAGAGACTGC | TGG |
| pNMG-310 | Hek-2 similar site | GAATACTAAGCATAGACTCC | AGG |
| pNMG-311 | Hek-2 similar site | GTAAACAAAGCATAGACTGA | GGG |
| pNMG-312 | Hek-2 similar site | GGACACAAAGCTTAGACTCC | AGG |
| pNMG-313 | Hek-2 similar site | CAATACAAAGGATAGACTGC | AGG |
| pNMG-314 | Hek-2 similar site | GAAGACCAAGGATAGACTGC | TGG |
| pNMG-315 | Hek-2 similar site | GAAAACAAATCATTGACTGC | AGG |
| pNMG-316 | Hek-2 similar site | GATCACAAAGCATGGACTGA | AGG |
| pNMG-317 | Hek-2 similar site | GAAAACAAACATAGAGTGC | TGG |
| pNMG-318 | Hek-2 similar site | GAACATAAAGAATAGAATGA | TGG |

Example 3—Evolution of Adenosine Base Editor Containing the A106V, D108N, D147Y, and E155V Mutations of ecTadA (Evolution #3)

An ecTadA construct with the consensus mutations A106V, D108N, D147Y (pNMG-184) and E155V was mutagenized with error-pone PCR and the resulting ABE library was targeted with 2 separate gRNAs to two different sites in a kanamycin resistance gene which require two A to G reversions (both in premature stop codons) to confer kanamycin resistance. The 2 gRNA/2 target approach was used to increase the stringency of the selection. See FIGS. 96-99. This evolution resulted in the identification of the following new mutations: L84F, H123Y and I157F.

Evolution #3 was performed analogously as evolution number 1 and 2, except bacterial plasmid pNMG-288 was used as a template, mutations in ecTadA (A106V_D108N_D147Y_E155V) and 2 gRNA expressed to target stop codons in selection plasmid pNMG-27-(Q4term+W15term). Libraries were plated on concentrations of kanamycin above the MIC. The most efficient base editor from evolution #3 was pNMG-371, which contains two ecTadA domains comprising the mutations L84F, A106V, D108N, H123Y, D147Y, E155V, and I156F.

Example 4—Evolution of Adenosine Base Editor ecTadA Residues E25, R26, R107, A142, and A143 to Increase Editing Efficiency of Adenine in Non-YAC Sequences (Evolution #4)

An ecTadA bacterial codon-optimized construct with the consensus mutations from evolution #2, A106V, D108N, D147Y and E155V, which is composed of one unit of ecTadA, an XTEN linker, and catalytically inactive Cas9 (dCas9), was mutagenized using NNK primers that target sites in ecTadA (e.g., E25, R26, R107, A142 and A143) to generate a site-saturated ABE library. Residues E25, R26, R107, A142 and A143 of ecTadA are hypothesized to make contact with the tRNA substrate with the wt ecTadA homodimer. For the NNK primers, N is A, T, C, or G, and K is G or T. The primers contain the mutations and are designed to bind at the 5 regions of interest, and a full-length product is obtained using PCR overlap extension protocol and assembled using USER junctions as used previously in the error-prone library assemblies. The 5 residues of ecTadA that were targeted included E25, R26, R107, A142 and A143. A goal of this evolution was to modify the "YAC" sequence preference of the adenosine base editor. In this round of evolution, the library of ABEs was selected against a spectinomycin resistance gene whose target A was presented in a non-YAC context. See FIGS. 101-123. The results from this round of evolution yielded mutations: R26G and A142N.

The ecTadA_2.2 deaminase construct was mutagenized to target active site residue in spectinomycin (T89). The gRNA targeted region: 5'-CAATGATGACTTCTACAGCG-3' (SEQ ID NO: 444) corresponds to a non "YAC" sequence. The targeted residues and their respective interactions are shown in Table 6.

TABLE 6

Shows the amino acid residues in saTadA and ecTadA responsible for the specifically listed interactions. The size of the library used in evolution #4 is $32^5$, which is the size of the library based on codon frequency.

| S. aureus TadA | E. coli TadA | interaction |
| --- | --- | --- |
| G22 | E25/R26 | carbonyl H-bond to 3' C tRNA substrate |
| D103 | R107 | carbonyl H-bond with 5' U in tRHA substrate |
| S138 | A142/A143 | carbonyl H-bond with 5' U in tRNA substrate |

The NNK library with ecTadA_2.2 deaminase template was generated from approximately 500 colonies total from plates containing 128, 256, 384 and 512 of ug/mL spectinomycin. The editor constructs were sub-cloned, re-transformed into S1030 with uncorrected spectinomycin T89I selection plasmid and re-challenged with increasing concentrations of spectinomycin to clarify the true positive phenotypes from random reversions. The editing results of the evolution #4 variants (NNK library) at sites HEK-2, HEK2-3, HEK2-6, HEK2-7, HEK2-10, HEK3, and FANCF sites are shown in FIGS. 108 through 122. The evolution #4 variants do not perform better than the evolution #3 variants and do not demonstrate a relaxed substrate specificity with respect to the "YAC" sequence.

The results of the evolution #4 mammalian transfection for sites HEK-2, HEK2-2, HEK2-3, HEK2-6, HEK2-7, and HEK2-10 sites are shown in FIG. 123. The ecTadA evolution round #4 mutations neither improve editing efficiencies nor broadened substrate tolerance.

The evolution #4 template for evolution for the target sites in ecTadA (A106V, D108N, D147Y, E155V) is given in Table 7, which identifies individual clones that were identified.

TABLE 7

Mutations identified in Evolution #4. The template for evolution: ecTadA (A106V, D108N, D147Y, and E155V).

| clone: | 25 | 26 | 107 | 142 | 143 |
| --- | --- | --- | --- | --- | --- |
|  | E | R | R | A | A |
| PLATE 1 | | | | | |
| 1 |  | M | G | P | N | D |
| 2 |  | D | G | K | N | G |
| 3 |  |  | N | A | N |  |
| 4 |  |  | Q |  | N |  |
| 5 |  | A | G | N | N | E |
| 6 |  |  | G | W | N |  |
| 7 |  |  |  |  | N | L |
| 8 |  | A | C |  | N | W |
| PLATE 2 | | | | | |
| 9 |  | D | G | K | N | G |
| 10 |  | R |  |  | N | L |
| 11 |  |  |  | H | N | M |
| 12 |  | M | G | P | N | D |
| 13 |  |  | Q |  | N |  |
| 14 |  | M | G |  | N | D |
| 15 |  |  | L |  | N | L |
| 16 |  | R |  |  | N | L |
| PLATE 3 | | | | | |
| 17 |  |  | C | H | N |  |
| 18 |  |  | G | H | N | G |
| 19 |  | V | G | S | D | S |
| 20 |  |  | Q |  | N |  |
| 21 |  | S | C |  | N | Q |
| 22 |  | Y | K |  | G | R |

Example 5—Evolution of Adenosine Base Editor Containing the L84F, A106V, D108N, H123Y, D147Y, E155V, and I157F Mutations of ecTadA (Evolution #5)

An ecTadA construct containing mutations from evolution #3, L84F, A106V, D108N, H123Y, D147Y, E155V, I157F (pNMG-325) was mutagenized with error-prone PCR and the resulting ABE library was targeted with 2 separate gRNAs to two different loci in two different antibiotic resistant genes: chloramphenicol and spectinomycin. Both target sequences contained a target A in a non-YAC context.

The editor plasmid encodes two different gRNA: chlor and spect, both of which are "non-YAC" targets. The chlor target sequence is 5'-TACGGCGTAGTGCACCTGGA-3' (SEQ ID NO: 441) and has a target "A" at position "9." The spect target sequence is 5'-CAATGATG ACTTCTACAGCG-3 (SEQ ID NO: 444) and has a target "A" at position "6." A schematic of the construct containing ecTadA and dCas9 used for ecTadA evolution (evolution #5) is shown in FIG. 124.

The library was transformed into S1030+selection plasmid, ABE expressed for 7 hours before plating on selection media: 128 ug/mL chloramphenicol (+kan/carb), 128 ug/mL chloramphenicol, 128 ug/mL spectinomycin (+kan/carb), 128 ug/mL chloramphenicol, 256 ug/mL spectinomycin (+kan/carb), 128 ug/mL chloramphenicol, 384 ug/mL spectinomycin (+kan/carb). The results of the clones assayed after fifth evolution #5 are shown in FIGS. 125 through 128. Surviving colonies are shown. The amplicons from spect selection clones assayed after evolution #5 are shown in FIG. 127. All colonies sequenced from double selection plates did not have any new mutations relative to the starting material.

Example 6—Examination of Mutations Introduced into the *S. aureus* TadA

Mutations were introduced into the *S. aureus* TadA (saTadA) based on the published crystal structure in Losey H. C., et al., "Crystal structure of *Staphylococcus aureus* tRNA adenosine deaminase TadA in complex with RNA," *Nature Structural and Molecular Biology*, 13, p. 153-159 (2006); the entire contents of which are hereby incorporated by reference. Based on the crystal structure of *S. aureus* TadA bound to its native tRNA substrate, 4 residues were selected for mutagenesis which made H-bond contact with the anticodon loop of the substrate. A first goal was to determine whether or not another version of an ABE editor could be made that could induce A to G mutations in DNA. For example, by using a TadA from another bacterial species (e.g., *S. aureus*). A second goal was to determine if the sequence specificity of a *S. aureus* editor was similar or different than the an ecTadA editor. A third goal was to test whether the editing efficiencies of an *S. aureus* ABE editor are improved as compared to an *E. coli* ABE editor. Briefly, mutations D104N, D103A, G22P, and S138A were made in saTadA. See constructs pNMG-345-350 in Table 4. The editing results of base editing at sites HEK-2, HEK2-1, HEK2-2, HEK2-3, HEK2-4, HEK2-6, HEK2-9, HEK2-10, HEK3, RNF2, and FANCF sites are shown in FIGS. 129 through 139. These figures show that mutations identified in ecTadA can be made in *S. Aureus* TadA (saTadA) to confer the ability of saTadA to deaminate adenine in DNA. The figures also show that the YAC sequence preference is similar for saTadA as it is for ecTadA.

Example 7—Testing ecTadA Homodimers vs Heterodimers and Linker Lengths of Adenosine Base Editors Adenosine base editor constructs were generated to test various linker lengths and various combinations of adenosine deaminase (e.g., wild-type ecTadA and/or mutant ecTadA domains) domains. For each construct the efficiency of mutating a target A to a G was tested. For example, constructs pNMG 492-500 and pNMG-513-518 were tested for their ability to generate A to G mutations in the DNA of cells. The identities of constructs pNMG 492-500 and pNMG-513-551 are shown in Table 4. Results of these tests are shown, for example, in FIGS. 141-149. Further, arginine residues within the adenosine deaminase of base editors were mutated to determine whether they had an effect on target sequence specificity, for example, their ability to mutate an A that is not part of a 5'-YAC-3' sequence, where Y is C or T, was tested. Results of these tests are shown, for example, in FIG. 141.

TABLE 8 sgRNA Plasmid key. The plasmid key below contains the protospacer sequence of the sgRNA sequence and identifies the reference plasmid number and site. For the protospacer sequence, the T is a U in the gRNA. In some embodiments, any of the gRNAs provided herein comprise any of the protospacer sequences in Table 8, where T is U.

| plasmid number | site | protospacer | SEQ ID NO: |
|---|---|---|---|
| pNMG-260 | RNF-multiA | AGAAAAACAATTTTAGTATT | 476 |
| pNMG-261 | HEK3-multiA | GCAGAAATAGACTAATTGCA | 477 |
| pNMG-299 | HEK2 | GAACACAAAGCATAGACTGC | 478 |
| pNMG-300 | HEK2 guideseq | GAACACAATGCATAGATTGC | 479 |
| pNMG-301 | HEK2-2 | GGAACACAAAGCATAGACTG | 480 |
| pNMG-302 | HEK2-3 | AACACAAAGCATAGACTGCG | 481 |
| pNMG-303 | HEK2-4 | ACAAAGCATAGACTGCGGGG | 482 |
| pNMG-304 | HEK2-5 | CAAAGCATAGACTGCGGGGC | 483 |
| pNMG-305 | HEK2-6 | GTGGTAATTTTCCAGCCCGC | 484 |
| pNMG-306 | HEK2-7 | CCTTTACAGGGCCAGCGGGC | 485 |
| pNMG-307 | HEK2-8 | CTGTCACAGTTAGCTCAGCC | 486 |
| pNMG-308 | HEK2-9 | GTGTTCCAGTTTCCTTTACA | 487 |
| pNMG-309 | HEK2 similar 1 | GAAAAAAAGCAGAGACTGC | 488 |
| pNMG-310 | TAC (HEK2 similar 2) | GAATACTAAGCATAGACTCC | 489 |
| pNMG-311 | AAC (HEK2 similar 3) | GTAAACAAAGCATAGACTGA | 490 |

TABLE 8-continued sgRNA Plasmid key. The plasmid key below contains the protospacer sequence of the sgRNA sequence and identifies the reference plasmid number and site. For the protospacer sequence, the T is a U in the gRNA. In some embodiments, any of the gRNAs provided herein comprise any of the protospacer sequences in Table 8, where T is U.

| plasmid number | site | protospacer | SEQ ID NO: |
|---|---|---|---|
| pNMG-312 | HEK2 similar 4 | GGACACAAAGCTTAGACTCC | 491 |
| pNMG-313 | HEK2 similar 5 | CAATACAAAGGATAGACTGC | 492 |
| pNMG-314 | GAC (HEK2 similar 6) | GAAGACCAAGGATAGACTGC | 493 |
| pNMG-315 | HEK2 similar 7 | GAAAACAAATCATTGACTGC | 494 |
| pNMG-316 | HEK2 similar 8 | GATCACAAAGCATGGACTGA | 495 |
| pNMG-317 | HEK2 similar 9 | GAAAACAAACATAGAGTGC | 496 |
| pNMG-318 | CAT (HEK2 similar 10) | GAACATAAAGAATAGAATGA | 497 |
| pNMG-380 | R1329* SCN1A | AATCAAGATAAGGCTCTTAG | 498 |
| pNMG-423 | R580* SCN1A | GCTCACCCTCTAAAGCTGAAA | 499 |
| pNMG-424 | C136Y PTEN (MDA-MB-415) | GTATATGCATATTTATTACAT | 500 |
| pNMG-425 | Q144* TP53 (NCI-H2171) | GCAGCTACACAGGGCAGGTCT | 501 |
| pNMG-426 | R306* TP53 (HCC1937) | GACCTCACTTAGTGCTCCCTG | 502 |
| pNMG-463 | CAG | GGACAGGCAGCATAGACTGT | 503 |
| pNMG-464 | GAA | GTAGAAAAGTATAGACTGC | 504 |
| pNMG-465 | GAG | GGAGAGAGAGCATAGACTGC | 505 |
| pNMG-466 | GAT | GAAGATAGAGAATAGACTGC | 506 |
| pNMG-467 | TAA | GGCTAAAGACCATAGACTGT | 507 |
| pNMG-468 | TAG | GTCTAGAAAGCTTAGACTGC | 508 |
| pNMG-469 | TAT | GAGTATGAGGCATAGACTGC | 509 |
| pNMG-470 | AAG | GTCAAGAAAGCAGAGACTGC | 510 |
| pNMG-471 | AAT | GGGAATAAATCATAGAATCC | 511 |
| pNMG-472 | CAA | GAGCAAAGACAATACACTGT | 512 |
| pNMG-501 | AAA | GACAAAGAGGAAGAGAGACG | 513 |
| pNMG-502 | SITE 2 | GGGGACGCGCTGGCTTCCCG | 514 |
| pNMG-503 | SITE 3 | GGACCGGCTCCCTGGCGGTC | 515 |
| pNMG-504 | SITE 4 | GCCACTTCTAAGCCCTTGAT | 516 |
| pNMG-505 | SITE5 | GGGAAAGACCCAGCATCCGT | 517 |
| pNMG-506 | SITE 6 | GCGGTACGCCGCTTCAGTGA | 518 |
| pNMG-507 | SITE 7 | GAAACTGGTCCCGTTTACAG | 519 |
| pNMG-508 | SITE 8 | GATGAGATAATGATGAGTCA | 520 |
| pNMG-509 | SITE 9 | GCCTAGGCAGTGGGGGTGCA | 521 |

TABLE 8-continued sgRNA Plasmid key. The plasmid key below contains the protospacer sequence of the sgRNA sequence and identifies the reference plasmid number and site. For the protospacer sequence, the T is a U in the gRNA. In some embodiments, any of the gRNAs provided herein comprise any of the protospacer sequences in Table 8, where T is U.

| plasmid number | site | protospacer | SEQ ID NO: |
|---|---|---|---|
| pNMG-510 | R196* TP53 (Calu-6) | GACTCAGATAAGATGCTGAGG | 522 |
| pNMG-511 | M237I TP53 (T98G) | GCATATGTAACAGTTCCTGCA | 523 |
| pNMG-512 | R273H TP53 (NCI-H1975) | GTGCATGTTTGTGCCTGTCC | 524 |
| pNMG-531 | EMX1-5 | GGGGATGGCAGGGCAGGAAG | 525 |
| pNMG-532 | EMX1-6 | GGGTTAGGGGCCCCAGGCCG | 526 |
| pNMG-533 | FANCF-7 | GGATGCAGCTCGTTACCACC | 527 |
| pNMG-534 | FANCF-5 | GCGCACGGTGGCGGGGTCCC | 528 |
| pNMG-535 | HEK3-6 | GGGCCAGGTCCCTCCTCTCC | 529 |
| pNMG-536 | HEK3-7 | GGATTGACCCAGGCCAGGGC | 530 |
| pNMG-537 | HEK4-5 | GATGACAGGCAGGGGCACCG | 531 |
| pNMG-538 | HEK4-6 | GGGCCAGTGAAATCACCCTG | 532 |
| pNMG-539 | RNF2-5 | GGGGACTTTGGGAGGTGATC | 533 |
| pNMG-540 | RNF2-6 | GCACCAGCAGATGCAGTGTC | 534 |
| pNMG-601 | RNF2-6 | GACACACACACTTAGAATCTG | 535 |
| pNMG-602 | RNF2-6 | GCACACACACTTAGAATCTGT | 536 |

Example 8—DNA Shuffling Using Nucleotide Exchange and Excision Technology (NExT) to Remove Epistatic Mutations, Evolution #6

To generate more efficient adenosine base editors and remove potential epistatic mutations constructs from evolutions 4, 5a, 5b and 2 were subjected to DNA shuffle experiments using Nucleotide Exchange and Excision Technology (NExT). A schematic representation of DNA shuffling is shown in FIGS. 150 and 151. Briefly, a DNA shuffle library was created. NExT shuffle and USER assembly, were transformed into 10B cells. The isolated DNA shuffle library was transformed into S1030 with selection plasmid. Plating was performed using 4 different selection conditions, including, low chlor, high chlor, high spect, and chlor plus spect after 7 hours of adenosine base editor induction. Incubation was performed at 37 C for 48 hours then colony PCR was performed on survivors. See FIGS. 150 and 151.

The sequence identity of the clones obtained from evolution #6 is shown in FIGS. 152 and 153. The mutations are given relative to SEQ ID NO: 1. FIG. 154 contains schematic representations of base editors derived from evolution #6. Evolution #6 identified mutations in P48 (e.g., P48T, P48S and P48A) and A142 (e.g., A142N), relative to SEQ ID NO: 1. These mutations improved the efficiency of base editors to mutate an A residue to a G in DNA. See, for example, the experimental results in FIGS. 155-158.

Example 9—Evolving Adenosine Base Editors to Efficiently Edit Multi A Sites, Evolution #7

To generate base editors that are more efficient at editing an A within a site containing multiple A residues (e.g., a 5'-AAA-3' sequence), base editors capable of editing a multi-A site were evolved. Evolution was performed by identifying evolved base editors that could correct two point mutations that conferred the ability of cells to be antibiotic (kan) resistant. See, for example, FIGS. 163-165. Mutations that improve base editing efficiency and/or the ability to edit an A at a multi-A site are shown in FIG. 164, where mutations are identified relative to SEQ ID NO: 1. Evolution #7 identified mutations in W23 (e.g., W23R, and W23L) and R152 (e.g., R152P, and R152H), relative to SEQ ID NO: 1. A summary of base editing efficiency for selected adenosine base editor constructs on various target sequences is shown in FIGS. 179-186. Tables 9 and 10 contain bacterial selection plasmid data.

TABLE 9

Bacterial selection plasmid data.

| selection plasmid | corresponding editor + gRNA | modification | protospacer (targeted selection) | position of target A | strand modification | origin | MIC (S1030) Kan |
|---|---|---|---|---|---|---|---|
| pNMG-208 | pNMG-255 | stop in Kan gene, W15 | 5'-GCTTAGGTGGAGCGCCTATT-3' (SEQ ID NO: 707) | 5 | coding | RSF1030 | 32 ug/mL |
| pNMG-209 | pNMG-257 | stop in Kan gene, R18 | 5'-AGTCACTCCACCCAAGCGGC-3' (SEQ ID NO: 708) | 5 | template | RSF1030 | 256 ug/mL |
| pNMG-210 | pNMG-259 | stop in Kan gene, R44 | 5'-GTCACCCCTGCGCTGACAGC-3' (SEQ ID NO: 709) | 4 | template | RSF1030 | 128 ug/mL |
| pNMG-211 | pNMG-253 | stop in Kan gene, Q4 | 5'-ATCTTATTCGATCATGCGAA-3' (SEQ ID NO: 710) | 6 | template | RSF1030 | 16 ug/mL |
| pNMG-212 | n/a | wt Kan gene | control plasmid | n/a | n/a | RSF1030 | >1056 ug/mL |
| pNMG-213 | pNMG-255 | pNMG-208 w/ SD8 RBS | 5'-GCTTAGGTGGAGCGCCTATT-3' (SEQ ID NO: 711) | 5 | template | RSF1030 | 528 ug/mL |
| pNMG-214 | pNMG-255 | pNMG-208 w/ SD3 RBS | 5'-GCTTAGGTGGAGCGCCTATT-3' (SEQ ID NO: 712) | 5 | template | RSF1030 | 128 ug/mL |
| pNMG-215 | pNMG-255 | pNMG-208 w/ SD2 RBS | 5'-GCTTAGGTGGAGCGCCTATT-3' (SEQ ID NO: 713) | 5 | template | RSF1030 | unknonwn |
| pNMG-216 | n/a | 2 stop, Q4 + R18 | 5'-ATCTTATTCGATCATGCGAA-3' (SEQ ID NO: 714), 5'-AGTCACTCCACCCAAGCGGC-3' (SEQ ID NO: 715) | 6 + 5 | template | RSF1030 | 8 ug/mL |
| pNMG-217 | n/a | 2 stop, W15 + R44 | 5'-GCTTAGGTGGAGCGCCTATT-3' (SEQ ID NO: 716), 5'-GTCACCCCTGCGCTGACAGC-3' (SEQ ID NO: 717) | 5 + 4 | both | RSF1030 | 8 ug/mL |
| pNMG-221 | n/a | 2 stop, W15 + R44 | 5'-GCTTAGGTGGAGCGCCTATT-3' (SEQ ID NO: 718), 5'-GTCACCCCTGCGCTGACAGC-3' (SEQ ID NO: 719) | 5 + 4 | both | CloDF3 | 4 ug/mL |

TABLE 10

Bacterial selection plasmid data

| selection plasmid | original Chlor selection | 5'-TACGGCGTAGTGCACCTGGA-3' (SEQ ID NO: 441) silent mutations in chlor site in italics, bold is target A: | | RSF 1030 | MIC (S1030) Chlor 1 ug/mL | SEQ ID NO: |
|---|---|---|---|---|---|---|
| pNMG-186 | original chlor site (H193Y) | 5'-TACTGTGTAATGTATCTGGA-3' | 9 | template | 1 ug/mL | 720 |
| pNMG-187 | original chlor site (H193Y) | 5'-TACTGCGTAGTGCACCTGGA-3' | 9 | template | 1 ug/mL | 721 |
| pNMG-188 | original chlor site (H193Y) | 5'-TACCGCGTAGTGCACCTGGA-3' | 9 | template | 1 ug/mL | 722 |
| pNMG-189 | original chlor site (H193Y) | 5'-TACAGCGTAGTGCACCTGGA-3' | 9 | template | 1 ug/mL | 723 |
| pNMG-190 | original chlor site (H193Y) | 5'-TACGGCGTAATGCACCTGGA-3' | 9 | template | 1 ug/mL | 724 |
| pNMG-191 | original chlor site (H193Y) | 5'-TACGGCATAGTGCACCTGGA-3' | 9 | template | 1 ug/mL | 725 |
| pNMG-192 | original chlor site (H193Y) | 5'-TACGGCGTAGTGTACCTGGA-3' | 9 | template | 1 ug/mL | 726 |
| pNMG-193 | original chlor site (H193Y) | 5'-TACGGCGTAGTGGACCTGGA-3' | 9 | template | 1 ug/mL | 727 |
| pNMG-194 | original chlor site (H193Y) | 5'-TACGGCGTAGTGAACCTGGA-3' | 9 | template | 1 ug/mL | 728 |
| pNMG-195 | original chlor site (H193Y) | 5'-TACGGCGTAGTGCACTTGGA-3' | 9 | template | 1 ug/mL | 729 |
| pNMG-196 | original chlor site (H193Y) | 5'-CGTAGTGCACCTGGATGGCC-3' | 4 | template | 1 ug/mL | 730 |
| pNMG-227 | chlor (1)_H193Y | 5'-TACCCGTAGTGAACTTGGA-3' | 9 | | 1 ug/mL | 731 |
| pNMG-228 | chlor (2)_H193Y | 5'-TACCCATAGTGAACTTGGA-3' | 7 + 9 | | 1 ug/mL | 732 | corresponding editor + gRNA corresponding editor +2 gRNA target

TABLE 10-continued

Bacterial selection plasmid data

| selection plasmid | original Chlor selection | 5'-TACGGCGTAGTGCACCTGGA-3' (SEQ ID NO: 441) silent mutations in chlor site in italics, bold is target A: | | | RSF 1030 | MIC (S1030) Chlor 1 ug/mL | SEQ ID NO: |
|---|---|---|---|---|---|---|---|
| Kan only | | | | | | | |
| pNMG-270 | stop in Kan gene, W15STOP | 5'-GCTTAGGTGGAGCGCCTATT-3' | 5 | | coding | | 733 |
| | stop in Kan gene, Q4STOP | 5'-ATCTTATTCGATCATGCGAA-3' | 6 | | template | | 734 |
| | original Chlor selection His193Y | 5'-TACGGCGTAGTGCACCTGGA-3' | 9 | | template | | 735 |
| pNMG-319 | stop in Kan gene, W15STOP | 5'-GCTTAGGTGGAGCGCCTATT-3' | 5 | | coding | | 733 |
| | stop in Kan gene, Q4STOP | 5'-ATCTTATTCGATCATGCGAA-3' | 6 | | template | | 734 |
| | chlor (2) | 5'-TACCGCATAGTGAACTTGGA-3' | 7 + 9 | | template | | 732 |
| pNMG-333 | spect gene: T89I mutation | 5'-CAATGATGACTTCTACAGCG-3' | 6 | | template | | 736 |
| round 4, evolve against spect only | | | | | | | |
| round 5: chlor + spect | chlor gene: H193Y mutation | 5'-TACGGCGTAGTGCACCTGGA-3' | 9 | | template | | 737 |
| round 6: spect + chlor | | | | | | | |
| pNMG-570 | kan gene D208N mutation | 5'-TTCATTAACTGTGGCCGGCT-3' | 7 | | coding | | 738 |
| round 7, evolve against two mutations, same gene kanamycin (Q4sop and D208N reversion needed) | | 5'-ATCTTATTCGATCATGCGAA-3' | 6 | | template | | 739 |

Example 10—Cas9 Variant Sequences

The disclosure provides Cas9 variants, for example Cas9 proteins from one or more organisms, which may comprise one or more mutations (e.g., to generate dCas9 or Cas9 nickase). In some embodiments, one or more of the amino acid residues, identified below by an asterisk, of a Cas9 protein may be mutated. In some embodiments, the D10 and/or H840 residues of the amino acid sequence provided in SEQ ID NO: 52, or a corresponding mutation in any of the amino acid sequences provided in SEQ ID NOs: 108-357, are mutated. In some embodiments, the D10 residue of the amino acid sequence provided in SEQ ID NO: 52, or a corresponding mutation in any of the amino acid sequences provided in SEQ ID NOs: 108-357, is mutated to any amino acid residue, except for D. In some embodiments, the D10 residue of the amino acid sequence provided in SEQ ID NO: 52, or a corresponding mutation in any of the amino acid sequences provided in SEQ ID NOs: 108-357, is mutated to an A. In some embodiments, the H840 residue of the amino acid sequence provided in SEQ ID NO: 52, or a corresponding residue in any of the amino acid sequences provided in SEQ ID NOs: 108-357, is an H. In some embodiments, the H840 residue of the amino acid sequence provided in SEQ ID NO: 52, or a corresponding mutation in any of the amino acid sequences provided in SEQ ID NOs: 108-357, is mutated to any amino acid residue, except for H. In some embodiments, the H840 residue of the amino acid sequence provided in SEQ ID NO: 52, or a corresponding mutation in any of the amino acid sequences provided in SEQ ID NOs: 108-357, is mutated to an A. In some embodiments, the D10 residue of the amino acid sequence provided in SEQ ID NO: 52, or a corresponding residue in any of the amino acid sequences provided in SEQ ID NOs: 108-357, is a D.

A number of Cas9 sequences from various species were aligned to determine whether corresponding homologous amino acid residues of D10 and H840 of SEQ ID NO: 52 or SEQ ID NO: 108 can be identified in other Cas9 proteins, allowing the generation of Cas9 variants with corresponding mutations of the homologous amino acid residues. The alignment was carried out using the NCBI Constraint-based Multiple Alignment Tool (COBALT (accessible at st-va.ncbi.nlm.nih.gov/tools/cobalt), with the following parameters. Alignment parameters: Gap penalties −11,−1; End-Gap penalties −5,−1. CDD Parameters: Use RPS BLAST on; Blast E-value 0.003; Find Conserved columns and Recompute on. Query Clustering Parameters: Use query clusters on; Word Size 4; Max cluster distance 0.8; Alphabet Regular.

An exemplary alignment of four Cas9 sequences is provided below. The Cas9 sequences in the alignment are: Sequence 1 (S1): SEQ ID NO: 108|WP_010922251|gi 499224711|type II CRISPR RNA-guided endonuclease Cas9 [*Streptococcus pyogenes*]; Sequence 2 (S2): SEQ ID NO: 109|WP_039695303|gi 746743737|type II CRISPR RNA-guided endonuclease Cas9 [*Streptococcus gallolyticus*]; Sequence 3 (S3): SEQ ID NO: 110|WP_045635197|gi 782887988|type II CRISPR RNA-guided endonuclease Cas9 [*Streptococcus mitis*]; Sequence 4 (S4): SEQ ID NO: 111|5AXW_A|gi 924443546|*Staphylococcus Aureus* Cas9. The HNH domain (bold and underlined) and the RuvC domain (boxed) are identified for each of the four sequences. Amino acid residues 10 and 840 in 51 and the homologous amino acids in the aligned sequences are identified with an asterisk following the respective amino acid residue.

```
S1    1  --MDKK-YSIGLD*IGTNSVGWAVITDEYKVPSKKFKVLGNTDRHSIKKNLI--GALLFDSG--ETAEATRLKRTARRRYT    73
S2    1  --MTKKNYSIGLD*IGTNSVGWAVITDDYKVPAKKMKVLGNTDKKYIKKNLL--GALLFDSG--ETAEATRLKRTARRRYT    74
S3    1  --M-KKGYSIGLD*IGTNSVGFAVITDDYKVPSKKMKVLGNTDKRFIKKNLI--GALLFDEG--TTAEARRLKRTARRRYT    73
S4    1  GSHMKRNYILGLD*IGITSVGYGII--DYET----------------RDVIDAGVRLFKEANVENNEGRRSKRGARRLKR    61

S1   74  RRKNRICYLQEIFSNEMAKVDDSFFHRLEESFLVEEDKKHERHPIFGNIVDEVAYHEKYPTIYHLRKKLVDSTDKADLRL   153
S2   75  RRKNRLRYLQEIFANEIAKVDESFFQRLDESFLTDDDKTFDSHPIFGNKAEEDAYHQKFPTIYHLRKHLADSSEKADLRL   154
S3   74  RRKNRLRYLQEIFSEEMSKVDSSFFHRLDDSFLIPEDKRESKYPIFATLTEEKEYHKQFPTIYHLRKQLADSKEKTDLRL   153
S4   62  RRRHRIQRVKKLL--------------FDYNLLTD-------------------HSELSGINPYEARVKGLSQKLSEEE   107

S1  154  IYLALAHMIKFRGHFLIEGDLNPDNSDVDKLFIQLVQTYNQLFEENPINASGVDAKAILSARLSKSRRLENLIAQLPGEK   233
S2  155  VYLALAHMIKFRGHFLIEGELNAENTDVQKIFADFVGVYNRTFDDSHLSEITVDVASILTEKISKSRRLENLIKYYPTEK   234
S3  154  IYLALAHMIKYRGHFLYEEAFDIKNNDIQKIFNEFISIYDNTFEGSSLSGQNAQVEAIFTDKISKSAKRERVLKLFPDEK   233
S4  108  FSAALLHLAKRRG--------------------VHNVNEVEEDT----------------------------------   131

S1  234  KNGLFGNLIALSLGLTPNFKSNFDLAEDAKLQLSKDTYDDDLDNLLAQIGDQYADLFLAAKNLSDAILLSDILRVNTEIT   313
S2  235  KNTLFGNLIALALGLQPNFKTNFKLSEDAKLQFSKDTYEEDLEELLGKIGDDYADLFTSAKNLYDAILLSGILTVDDNST   314
S3  234  STGLFSEFLKLIVGNQADFKKHFDLEDKAPLQFSKDTYDEDLENLLGQIGDDFTDLFVSAKKLYDAILLSGILTVTDPST   313
S4  132  -----GNELS-------------TKEQISRN-------------------------------------------   144

S1  314  KAPLSASMIKRYDEHHQDLTLLKALVRQQLPEKYKEIFFDQSKNGYAGYIDGGASQEEFYKFIKPILEKM--DGTEELLV   391
S2  315  KAPLSASMIKRYVEHHEDLEKLKEFIKANKSELYHDIFKDKNKNGYAGYIENGVKQDEFYKYLKNILSKIKIDGSDYFLD   394
S3  314  KAPLSASMIERYENHQNDLAALKQFIKNNLPEKYDEVFSDQSKDGYAGYIDGKTTQETFYKYIKNLLSKF--EGTDYFLD   391
S4  145  ----SKALEEKYVAELQ-----------------------------------------------LERLKKDG------   165

S1  392  KLNREDLLRKQRTFDNGSIPHQIHLGELHAILRRQEDFYPFLKDNREKIEKILTFRIPYYVGPLARGNSRFAWMTRKSEE   471
S2  395  KIEREDFLRKQRTFDNGSIPHQIHLQEMHAILRRQGDYYPFLKEKQDRIEKILTFRIPYYVGPLVRKDSRFAWAEYRSDE   474
S3  392  KIEREDFLRKQRTFDNGSIPHQIHLQEMNAILRRQGEYYPFLKDNKEKIEKILTFRIPYYVGPLARGNRDFAWLTRNSDE   471
S4  166  --EVRGSINRFKTSD--------YVKEAKQLLKVQKAYHQLDQSFIDTYIDLLETRRTYYEGP--GEGSPFGW------K   227

S1  472  TITPWNFEEVVDKGASAQSFIERMTNFDKNLPNEKVLPKHSLLYEYFTVYNELTKVKYVTEGMRKPAFLSGEQKKAIVDL   551
S2  475  KITPWNFDKVIDKEKSAEKFITRMTLNDLYLPEEKVLPKHSHVYETYAVYNELTKIKYVNEQGKE-SFFDSNMKQEIFDH   553
S3  472  AIRPWNFEEIVDKASSAEDFINKMTNYDLYLPEEKVLPKHSLLYETFAVYNELTKVKFIAEGLRDYQFLDSGQKKQIVNQ   551
S4  228  DIKEW--------------YEMLMGHCTYFPEELRSVKYAYNADLYNALNDLNNLVITRDENEK---LEYYEKFQIIEN   289

S1  552  LFKTNRKVTVKQLKEDYFKKIECFDSVEISGVEDR---FNASLGTYHDLLKIIKDKDFLDNEENEDILEDIVLTLTLFED   628
S2  554  VFKENRKVTKEKLLNYLNKEFPEYRIKDLIGLDKENKSFNASLGTYHDLKKIL-DKAFLDDKVNEEVIEDIIKTLTLFED   632
S3  552  LFKENRKVTEKDIIHYLHN-VDGYDGIELKGIEKQ---FNASLSTYHDLLKIIKDKEFMDDAKNEAILENIVHTLTIFED   627
S4  290  VFKQKKKPTLKQIAKEILVNEEDIKGYRVTSTGKPEF---TNLKVYHDIKDITARKEII---ENAELLDQIAKILTIYQS   363

S1  629  REMIEERLKTYAHLFDDKVMKQLKR-RRYTGWGRLSRKLINGIRDKQSGKTILDFLKSDGFANRNFMQLIHDDSLTFKED   707
S2  633  KDMIHERLQKYSDIFTANQLKKLER-RHYTGWGRLSYKLINGIRNKENNKTILDYLIDDGSANRNFMQLINDDTLPFKQI   711
S3  628  REMIKQRLAQYDSLFDEKVIKALTR-RHYTGWGKLSAKLINGICDKQTGNTILDYLIDDGKINRNFMQLINDDGLSFKEI   706
```

-continued

```
S4   364 SEDIQEELTNLNSELTQEEIEQISNLKGYTGTHNLSLKAINLILDE------LWHTNDNQIAIFNRLKLVP---------  428

S1   708 IQKAQVSGQGDSLHEHIANLAGSPAIKKGILQTVKVVDELVKVMGRHKPENIVIEMARENQTT------QKGQKNSRERM   781
S2   712 IQKSQVVGDVDDIEAVVHDLPGSPAIKKGILQSVKIVDELVKVMG-GNPDNIVIEMARENQTT------NRGRSQSQQRL   784
S3   707 IQKAQVIGKTDDVKQVVQELSGSPAIKKGILQSIKIVDELVKVMG-HAPESIVIEMARENQTT------ARGKKNSQQRY   779
S4   429 -KKVDLSQQKEIPTTLVDDFILSPVVKRSFIQSIKVINAIIKKYG--LPNDIIIELAREKNSKDAQKMINEMQKRNRQTN   505

S1   782 KRIEEGIKELGSQIL-------KEHPVENTQLQNEKLYLYYLQNGRDMYVDQELDINRLSD----YDVDH*IVPQSFLKDD  850
S2   785 KKLQNSLKELGSNILNEEKPSYIEDKVENSHLQNDQLFLYYIQNGKDMYTGDELDIDHLSD----YDIDH*IIPQAFIKDD  860
S3   780 KRIEDSLKILASGL---DSNILKENPTDNNQLQNDRLFLYYLQNGKDMYTGEALDINQLSS----YDIDH*IIPQAFIKDD  852
S4   506 ERIEEIIRTTGK---------------ENAKYLIEKIKLHDMQEGKCLYSLEAIPLEDLLNNPFNYEVDH*IIPRSVSFDN  570

S1   851 SIDNKVLTRSDKNRGKSDNVPSEEVVKKMKNYWRQLLNAKLITQRKFDN-LTKAERGGL-SELD------KAGFIKRQLV   922
S2   861 SIDNRVLTSSAKNRGKSDDVPSLDIVRARKAEWVRLYKSGLISKRKFDN-LTKAERGGL-TEAD------KAGFIKRQLV   932
S3   853 SLDNRVLTSSKDNRGKSDNVPSIEVVQKRKAFWQQLLDSKLISERKFNN-LTKAERGGL-DERD------KVGFIKRQLV   924
S4   571 SFNNKVLVKQEEASKKGNRTPFQYLSSSDSKISYETFKKHILNLAKGKGRISKTKKEYLLEERDINRFSVQKDFINRNLV   650

S1   923 ETRQITKHVAQILDSRMNTKYDENDKLIREVKVITLKSKLVSDFRKDFQFYKVREINNYHHAHDAYLNAVVGTALIKKYP  1002
S2   933 ETRQITKHVAQILDARFNTEHDENDKVIRDVKVITLKSNLVSQFRKDFEFYKVREINDYHHAHDAYLNAVVGTALLKKYP  1012
S3   925 ETRQITKHVAQILDARYNTEVNEKDKKNRTVKIITLKSNLVSNFRKEFRLYKVREINDYHHAHDAYLNAVVAKAILKKYP  1004
S4   651 DTRYATRGLMNLLRSYFRVN-------NLDVKVKSINGGFTSFLRRKWKFKKERNKGYKHHAEDALIIA----------   712

S1  1003 KLESEFVYGDYKVYDVRKMIAKSEQ--EIGKATAKYFFYSNIMNFFKTEITLANGEIRKRPLIETNGETGEIVWDKG---  1077
S2  1013 KLASEFVYGEYKKYDIRKFITNSSD-----KATAKYFFYSNLMNPFFKTKVKYADGTVFERPIIETNAD-GEIAWNKQ---  1083
S3  1005 KLEPEFVYGEYQKYDLKRYISRSKDPKEVEKATEKYFFYSNLLNPFFKEEVHYADGTIVKRENIEYSKDTGEIAWNKE---  1081
S4   713 --NADFIFKEWKKLDKAKKVMENQM-----------------------FEEKQAESMPEIETEQEYKEIFITPHQIK   764

S1  1078 -----RDFATVRKVLSMPQVNIVKKTEVQTGGFSKESILPKRNSDKLIARKKD---WDPKKYGGFDSPTVAYSVLVVAKV  1149
S2  1084 -----IDFEKVRKVLSYPQVNIVKKVETQTGGFSKESILPKGDSDKLIPRKTKKVYWDTKKYGGFDSPTVAYSVFVVADV  1158
S3  1082 -----KDFAIIKKVLSLPQVNIVKKREVQTGGFSKESILPKGNSDKLIPRKTKDILLDTTKYGGFDSPVIAYSILLIADI  1156
S4   765 HIKDFKDYKYSHRVDKKPNRELINDTLYSTRKDDKGNTLIVNNLNGLYDKDNDKL----KKLIN-KSP----EKLLMYHH   835

S1  1150 EKGKSKKLKSVKELLGITIMERSSFEKNPI-DFLEAKG-----YKEVKKDLIIKLPKYSLFELENGRKRMLASAGELQKG  1223
S2  1159 EKGKAKKLKTVKELVGISIMERSFFEENPV-EFLENKG-----YHNIREDKLIKLPKYSLFEFEGGRRRLLASASELQKG  1232
S3  1157 EKGKAKKLKTVKTLVGITIMEKAAFEENPI-TFLENKG-----YHNVRKENILCLPKYSLFELENGRRRLLASAKELQKG  1230
S4   836 DPQTYQKLK--------LIMEQYGDEKNPLYKYYEETGNYLTKYSKKDNGPVIKKIKYYGNKLNAHLDITDDYPNSRNKV   907

S1  1224 NELALPSKYVNFLYLASHYEKLKGSPEDNEQKQLFVEQHKYLDEIIEQISEFSKRVILADANLDKVLSAYNKH------  1297
S2  1233 NEMVLPGYLVELLYHAHRADNF-----NSTEYLNYVSEHKKEFEKVLSCVEDFANLYVDVEKNLSKIRAVADSM------  1301
S3  1231 NEIVLPVYLTTLLYHSKNVHKL-----DEPGHLEYIQKHRNEFKDLLNLVSEFSQKYVLADANLEKIKSLYADN------  1299
S4   908 VKLSLKPYRFD-VYLDNGVYKFV-----TVKNLDVIK--KENYYEVNSKAYEEAKKLKKISNQAEFIASFYNNDLIKING   979

S1  1298 RDKPIREQAENIIHLFTLTNLGAPAAFKYFDTTIDRKRYTSTKEVLDATLIHQSIT--------GLYETRI----DLSQL  1365
S2  1302 DNFSIEEISNSFINLLTLTALGAPADFNFLGEKIPRKRYTSTKECLNATLIHQSIT--------GLYETRI----DLSKL  1369
S3  1300 EQADIEILANSFINLLTFTALGAPAAFKFFGKDIDRKRYTTVSEFLNATLIHQSIT--------GLYETWI----DLSKL  1367
S4   980 ELYRVIGVNNDLLNRIEVNMIDITYR-EYLENMNDKRPPRIIKTIASKT---QSIKKYSTDILGNLYEVKSKKHPQIIKK  1055

S1  1366 GGD                                                                             1368
S2  1370 GEE                                                                             1372
S3  1368 GED                                                                             1370
S4  1056 G--                                                                             1056
```

The alignment demonstrates that amino acid sequences and amino acid residues that are homologous to a reference Cas9 amino acid sequence or amino acid residue can be identified across Cas9 sequence variants, including, but not limited to Cas9 sequences from different species, by identifying the amino acid sequence or residue that aligns with the reference sequence or the reference residue using alignment programs and algorithms known in the art. This disclosure provides Cas9 variants in which one or more of the amino acid residues identified by an asterisk in SEQ ID NOs: 108-111 (e.g., 51, S2, S3, and S4, respectively) are mutated as described herein. The residues D10 and H840 in Cas9 of SEQ ID NO: 52 that correspond to the residues identified in SEQ ID NOs: 108-111 by an asterisk are referred to herein as "homologous" or "corresponding" residues. Such homologous residues can be identified by sequence alignment, e.g., as described above, and by identifying the sequence or residue that aligns with the reference sequence or residue. Similarly, mutations in Cas9 sequences that correspond to mutations identified in SEQ ID NO: 52 herein, e.g., mutations of residues 10, and 840 in SEQ ID NO: 52, are referred to herein as "homologous" or "corresponding" mutations. For example, the mutations corresponding to the D10A mutation in SEQ ID NO: 52 or 51 (SEQ ID NO: 108) for the four aligned sequences above are D11A for S2, D10A for S3, and D13A for S4; the corresponding mutations for H840A in SEQ ID NO: 52 or 51 (SEQ ID NO: 108) are H850A for S2, H842A for S3, and H560A for S4.

A total of 250 Cas9 sequences (SEQ ID NOs: 108-357) from different species were aligned using the same algorithm and alignment parameters outlined above. Amino acid residues homologous to residues 10, and 840 of SEQ ID NO: 52 were identified in the same manner as outlined above. The alignments are provided below. The HNH domain (bold and underlined) and the RuvC domain (boxed) are identified for each of the four sequences. Single residues corresponding to amino acid residues 10, and 840 in SEQ ID NO: 52 are boxed in SEQ ID NO: 108 in the alignments, allowing for the identification of the corresponding amino acid residues in the aligned sequences.

| Accession | Description | SEQ ID NO |
|---|---|---|
| WP_010922251.1 | type II CRISPR RNA-guided endonuclease Cas9 [Streptococcus pyogenes] | SEQ ID NO: 108 |
| WP_039695303.1 | type II CRISPR RNA-guided endonuclease Cas9 [Streptococcus gallolyticus] | SEQ ID NO: 109 |
| WP_045635197.1 | type II CRISPR RNA-guided endonuclease Cas9 [Streptococcus mitis] | SEQ ID NO: 110 |
| 5AXW_A | Cas9, Chain A, Crystal Structure [Staphylococcus Aureus] | SEQ ID NO: 111 |
| WP_009880683.1 | type II CRISPR RNA-guided endonuclease Cas9 [Streptococcus pyogenes] | SEQ ID NO: 112 |
| WP_010922251.1 | type II CRISPR RNA-guided endonuclease Cas9 [Streptococcus pyogenes] | SEQ ID NO: 113 |
| WP_011054416.1 | type II CRISPR RNA-guided endonuclease Cas9 [Streptococcus pyogenes] | SEQ ID NO: 114 |
| WP_011284745.1 | type II CRISPR RNA-guided endonuclease Cas9 [Streptococcus pyogenes] | SEQ ID NO: 115 |
| WP_011285506.1 | type II CRISPR RNA-guided endonuclease Cas9 [Streptococcus pyogenes] | SEQ ID NO: 116 |
| WP_011527619.1 | type II CRISPR RNA-guided endonuclease Cas9 [Streptococcus pyogenes] | SEQ ID NO: 117 |
| WP_012560673.1 | type II CRISPR RNA-guided endonuclease Cas9 [Streptococcus pyogenes] | SEQ ID NO: 118 |
| WP_014407541.1 | type II CRISPR RNA-guided endonuclease Cas9 [Streptococcus pyogenes] | SEQ ID NO: 119 |
| WP_020905136.1 | type II CRISPR RNA-guided endonuclease Cas9 [Streptococcus pyogenes] | SEQ ID NO: 120 |
| WP_023080005.1 | type II CRISPR RNA-guided endonuclease Cas9 [Streptococcus pyogenes] | SEQ ID NO: 121 |
| WP_023610282.1 | type II CRISPR RNA-guided endonuclease Cas9 [Streptococcus pyogenes] | SEQ ID NO: 122 |
| WP_030125963.1 | type II CRISPR RNA-guided endonuclease Cas9 [Streptococcus pyogenes] | SEQ ID NO: 123 |
| WP_030126706.1 | type II CRISPR RNA-guided endonuclease Cas9 [Streptococcus pyogenes] | SEQ ID NO: 124 |
| WP_031488318.1 | type II CRISPR RNA-guided endonuclease Cas9 [Streptococcus pyogenes] | SEQ ID NO: 125 |

| | | |
|---|---|---|
| WP_032460140.1 | type II CRISPR RNA-guided endonuclease Cas9 [Streptococcus pyogenes] | SEQ ID NO: 126 |
| WP_032461047.1 | type II CRISPR RNA-guided endonuclease Cas9 [Streptococcus pyogenes] | SEQ ID NO: 127 |
| WP_032462016.1 | type II CRISPR RNA-guided endonuclease Cas9 [Streptococcus pyogenes] | SEQ ID NO: 128 |
| WP_032462936.1 | type II CRISPR RNA-guided endonuclease Cas9 [Streptococcus pyogenes] | SEQ ID NO: 129 |
| WP_032464890.1 | type II CRISPR RNA-guided endonuclease Cas9 [Streptococcus pyogenes] | SEQ ID NO: 130 |
| WP_033888930.1 | type II CRISPR RNA-guided endonuclease Cas9 [Streptococcus pyogenes] | SEQ ID NO: 131 |
| WP_038431314.1 | type II CRISPR RNA-guided endonuclease Cas9 [Streptococcus pyogenes] | SEQ ID NO: 132 |
| WP_038432938.1 | type II CRISPR RNA-guided endonuclease Cas9 [Streptococcus pyogenes] | SEQ ID NO: 133 |
| WP_038434062.1 | type II CRISPR RNA-guided endonuclease Cas9 [Streptococcus pyogenes] | SEQ ID NO: 134 |
| BAQ51233.1 | CRISPR-associated protein, Csn1 family [Streptococcus pyogenes] | SEQ ID NO: 135 |
| KGE60162.1 | hypothetical protein MGAS2111_0903 [Streptococcus pyogenes MGAS2111] | SEQ ID NO: 136 |
| KGE60856.1 | CRISPR-associated endonuclease protein [Streptococcus pyogenes SS1447] | SEQ ID NO: 137 |
| WP_002989955.1 | MULTISPECIES: type II CRISPR RNA-guided endonuclease Cas9 [Streptococcus] | SEQ ID NO: 138 |
| WP_003030002.1 | MULTISPECIES: type II CRISPR RNA-guided endonuclease Cas9 [Streptococcus] | SEQ ID NO: 139 |
| WP_003065552.1 | MULTISPECIES: type II CRISPR RNA-guided endonuclease Cas9 [Streptococcus] | SEQ ID NO: 140 |
| WP_001040076.1 | type II CRISPR RNA-guided endonuclease Cas9 [Streptococcus agalactiae] | SEQ ID NO: 141 |
| WP_001040078.1 | type II CRISPR RNA-guided endonuclease Cas9 [Streptococcus agalactiae] | SEQ ID NO: 142 |
| WP_001040080.1 | type II CRISPR RNA-guided endonuclease Cas9 [Streptococcus agalactiae] | SEQ ID NO: 143 |
| WP_001040081.1 | type II CRISPR RNA-guided endonuclease Cas9 [Streptococcus agalactiae] | SEQ ID NO: 144 |
| WP_001040083.1 | type II CRISPR RNA-guided endonuclease Cas9 [Streptococcus agalactiae] | SEQ ID NO: 145 |
| WP_001040085.1 | type II CRISPR RNA-guided endonuclease Cas9 [Streptococcus agalactiae] | SEQ ID NO: 146 |
| WP_001040087.1 | type II CRISPR RNA-guided endonuclease Cas9 [Streptococcus agalactiae] | SEQ ID NO: 147 |

| Accession | Description | SEQ ID NO |
|---|---|---|
| WP_001040088.1 | type II CRISPR RNA-guided endonuclease Cas9 [Streptococcus agalactiae] | SEQ ID NO: 148 |
| WP_001040089.1 | type II CRISPR RNA-guided endonuclease Cas9 [Streptococcus agalactiae] | SEQ ID NO: 149 |
| WP_001040090.1 | type II CRISPR RNA-guided endonuclease Cas9 [Streptococcus agalactiae] | SEQ ID NO: 150 |
| WP_001040091.1 | type II CRISPR RNA-guided endonuclease Cas9 [Streptococcus agalactiae] | SEQ ID NO: 151 |
| WP_001040092.1 | type II CRISPR RNA-guided endonuclease Cas9 [Streptococcus agalactiae] | SEQ ID NO: 152 |
| WP_001040094.1 | type II CRISPR RNA-guided endonuclease Cas9 [Streptococcus agalactiae] | SEQ ID NO: 153 |
| WP_001040095.1 | type II CRISPR RNA-guided endonuclease Cas9 [Streptococcus agalactiae] | SEQ ID NO: 154 |
| WP_001040096.1 | type II CRISPR RNA-guided endonuclease Cas9 [Streptococcus agalactiae] | SEQ ID NO: 155 |
| WP_001040097.1 | type II CRISPR RNA-guided endonuclease Cas9 [Streptococcus agalactiae] | SEQ ID NO: 156 |
| WP_001040098.1 | type II CRISPR RNA-guided endonuclease Cas9 [Streptococcus agalactiae] | SEQ ID NO: 157 |
| WP_001040099.1 | type II CRISPR RNA-guided endonuclease Cas9 [Streptococcus agalactiae] | SEQ ID NO: 158 |
| WP_001040100.1 | type II CRISPR RNA-guided endonuclease Cas9 [Streptococcus agalactiae] | SEQ ID NO: 159 |
| WP_001040104.1 | type II CRISPR RNA-guided endonuclease Cas9 [Streptococcus agalactiae] | SEQ ID NO: 160 |
| WP_001040105.1 | type II CRISPR RNA-guided endonuclease Cas9 [Streptococcus agalactiae] | SEQ ID NO: 161 |
| WP_001040106.1 | type II CRISPR RNA-guided endonuclease Cas9 [Streptococcus agalactiae] | SEQ ID NO: 162 |
| WP_001040107.1 | type II CRISPR RNA-guided endonuclease Cas9 [Streptococcus agalactiae] | SEQ ID NO: 163 |
| WP_001040108.1 | type II CRISPR RNA-guided endonuclease Cas9 [Streptococcus agalactiae] | SEQ ID NO: 164 |
| WP_001040109.1 | type II CRISPR RNA-guided endonuclease Cas9 [Streptococcus agalactiae] | SEQ ID NO: 165 |
| WP_001040110.1 | type II CRISPR RNA-guided endonuclease Cas9 [Streptococcus agalactiae] | SEQ ID NO: 166 |
| WP_015058523.1 | type II CRISPR RNA-guided endonuclease Cas9 [Streptococcus agalactiae] | SEQ ID NO: 167 |
| WP_017643650.1 | type II CRISPR RNA-guided endonuclease Cas9 [Streptococcus agalactiae] | SEQ ID NO: 168 |
| WP_017647151.1 | type II CRISPR RNA-guided endonuclease Cas9 [Streptococcus agalactiae] | SEQ ID NO: 169 |
| WP_017648376.1 | type II CRISPR RNA-guided endonuclease Cas9 [Streptococcus agalactiae] | SEQ ID NO: 170 |
| WP_017649527.1 | type II CRISPR RNA-guided endonuclease Cas9 [Streptococcus agalactiae] | SEQ ID NO: 171 |
| WP_017771611.1 | type II CRISPR RNA-guided endonuclease Cas9 [Streptococcus agalactiae] | SEQ ID NO: 172 |
| WP_017771984.1 | type II CRISPR RNA-guided endonuclease Cas9 [Streptococcus agalactiae] | SEQ ID NO: 173 |
| CFQ25032.1 | CRISPR-associated protein [Streptococcus agalactiae] | SEQ ID NO: 174 |

| | | |
|---|---|---|
| CFV16040.1 | CRISPR-associated protein [Streptococcus agalactiae] | SEQ ID NO: 175 |
| KLJ37842.1 | CRISPR-associated protein Csn1 [Streptococcus agalactiae] | SEQ ID NO: 176 |
| KLJ72361.1 | CRISPR-associated protein Csn1 [Streptococcus agalactiae] | SEQ ID NO: 177 |
| KLL20707.1 | CRISPR-associated protein Csn1 [Streptococcus agalactiae] | SEQ ID NO: 178 |
| KLL42645.1 | CRISPR-associated protein Csn1 [Streptococcus agalactiae] | SEQ ID NO: 179 |
| WP_047207273.1 | type II CRISPR RNA-guided endonuclease Cas9 [Streptococcus agalactiae] | SEQ ID NO: 180 |
| WP_047209694.1 | type II CRISPR RNA-guided endonuclease Cas9 [Streptococcus agalactiae] | SEQ ID NO: 181 |
| WP_050198062.1 | type II CRISPR RNA-guided endonuclease Cas9 [Streptococcus agalactiae] | SEQ ID NO: 182 |
| WP_050201642.1 | type II CRISPR RNA-guided endonuclease Cas9 [Streptococcus agalactiae] | SEQ ID NO: 183 |
| WP_050204027.1 | type II CRISPR RNA-guided endonuclease Cas9 [Streptococcus agalactiae] | SEQ ID NO: 184 |
| WP_050881965.1 | type II CRISPR RNA-guided endonuclease Cas9 [Streptococcus agalactiae] | SEQ ID NO: 185 |
| WP_050886065.1 | type II CRISPR RNA-guided endonuclease Cas9 [Streptococcus agalactiae] | SEQ ID NO: 186 |
| AHN30376.1 | CRISPR-associated protein Csn1 [Streptococcus agalactiae 138P] | SEQ ID NO: 187 |
| EAO78426.1 | reticulocyte binding protein [Streptococcus agalactiae H36B] | SEQ ID NO: 188 |
| CCW42055.1 | CRISPR-associated protein, SAG0894 family [Streptococcus agalactiae ILRI112] | SEQ ID NO: 189 |
| WP_003041502.1 | type II CRISPR RNA-guided endonuclease Cas9 [Streptococcus anginosus] | SEQ ID NO: 190 |
| WP_037593752.1 | type II CRISPR RNA-guided endonuclease Cas9 [Streptococcus anginosus] | SEQ ID NO: 191 |
| WP_049516684.1 | CRISPR-associated protein Csn1 [Streptococcus anginosus] | SEQ ID NO: 192 |
| GAD46167.1 | hypothetical protein ANG6_0662 [Streptococcus anginosus T5] | SEQ ID NO: 193 |
| WP_018363470.1 | type II CRISPR RNA-guided endonuclease Cas9 [Streptococcus caballi] | SEQ ID NO: 194 |
| WP_003043819.1 | type II CRISPR RNA-guided endonuclease Cas9 [Streptococcus canis] | SEQ ID NO: 195 |
| WP_006269658.1 | type II CRISPR RNA-guided endonuclease Cas9 [Streptococcus constellatus] | SEQ ID NO: 196 |
| WP_048800889.1 | type II CRISPR RNA-guided endonuclease Cas9 [Streptococcus constellatus] | SEQ ID NO: 197 |
| WP_012767106.1 | type II CRISPR RNA-guided endonuclease Cas9 [Streptococcus dysgalactiae] | SEQ ID NO: 198 |
| WP_014612333.1 | type II CRISPR RNA-guided endonuclease Cas9 [Streptococcus dysgalactiae] | SEQ ID NO: 199 |
| WP_015017095.1 | type II CRISPR RNA-guided endonuclease Cas9 [Streptococcus dysgalactiae] | SEQ ID NO: 200 |
| WP_015057649.1 | type II CRISPR RNA-guided endonuclease Cas9 [Streptococcus dysgalactiae] | SEQ ID NO: 201 |

| | | |
|---|---|---|
| WP_048327215.1 | type II CRISPR RNA-guided endonuclease Cas9 [Streptococcus dysgalactiae] | SEQ ID NO: 202 |
| WP_049519324.1 | CRISPR-associated protein Csn1 [Streptococcus dysgalactiae] | SEQ ID NO: 203 |
| WP_012515931.1 | type II CRISPR RNA-guided endonuclease Cas9 [Streptococcus equi] | SEQ ID NO: 204 |
| WP_021320964.1 | type II CRISPR RNA-guided endonuclease Cas9 [Streptococcus equi] | SEQ ID NO: 205 |
| WP_037581760.1 | type II CRISPR RNA-guided endonuclease Cas9 [Streptococcus equi] | SEQ ID NO: 206 |
| WP_004232481.1 | type II CRISPR RNA-guided endonuclease Cas9 [Streptococcus equinus] | SEQ ID NO: 207 |
| WP_009854540.1 | type II CRISPR RNA-guided endonuclease Cas9 [Streptococcus gallolyticus] | SEQ ID NO: 208 |
| WP_012962174.1 | type II CRISPR RNA-guided endonuclease Cas9 [Streptococcus gallolyticus] | SEQ ID NO: 209 |
| WP_039695303.1 | type II CRISPR RNA-guided endonuclease Cas9 [Streptococcus gallolyticus] | SEQ ID NO: 210 |
| WP_014334983.1 | type II CRISPR RNA-guided endonuclease Cas9 [Streptococcus infantarius] | SEQ ID NO: 211 |
| WP_003099269.1 | type II CRISPR RNA-guided endonuclease Cas9 [Streptococcus iniae] | SEQ ID NO: 212 |
| AHY15608.1 | CRISPR-associated protein Csn1 [Streptococcus iniae] | SEQ ID NO: 213 |
| AHY17476.1 | CRISPR-associated protein Csn1 [Streptococcus iniae] | SEQ ID NO: 214 |
| ESR09100.1 | hypothetical protein IUSA1_08595 [Streptococcus iniae IUSA1] | SEQ ID NO: 215 |
| AGM98575.1 | CRISPR-associated protein Cas9/Csn1, subtype II/NMEMI [Streptococcus iniae SF1] | SEQ ID NO: 216 |
| ALF27331.1 | CRISPR-associated protein Csn1 [Streptococcus intermedius] | SEQ ID NO: 217 |
| WP_018372492.1 | type II CRISPR RNA-guided endonuclease Cas9 [Streptococcus massiliensis] | SEQ ID NO: 218 |
| WP_045618028.1 | type II CRISPR RNA-guided endonuclease Cas9 [Streptococcus mitis] | SEQ ID NO: 219 |
| WP_045635197.1 | type II CRISPR RNA-guided endonuclease Cas9 [Streptococcus mitis] | SEQ ID NO: 220 |
| WP_002263549.1 | type II CRISPR RNA-guided endonuclease Cas9 [Streptococcus mutans] | SEQ ID NO: 221 |
| WP_002263887.1 | type II CRISPR RNA-guided endonuclease Cas9 [Streptococcus mutans] | SEQ ID NO: 222 |
| WP_002264920.1 | type II CRISPR RNA-guided endonuclease Cas9 [Streptococcus mutans] | SEQ ID NO: 223 |
| WP_002269043.1 | type II CRISPR RNA-guided endonuclease Cas9 [Streptococcus mutans] | SEQ ID NO: 224 |
| WP_002269448.1 | type II CRISPR RNA-guided endonuclease Cas9 [Streptococcus mutans] | SEQ ID NO: 225 |
| WP_002271977.1 | type II CRISPR RNA-guided endonuclease Cas9 [Streptococcus mutans] | SEQ ID NO: 226 |
| WP_002272766.1 | type II CRISPR RNA-guided endonuclease Cas9 [Streptococcus mutans] | SEQ ID NO: 227 |
| WP_002273241.1 | type II CRISPR RNA-guided endonuclease Cas9 [Streptococcus mutans] | SEQ ID NO: 228 |

| Accession | Description | SEQ ID NO |
|---|---|---|
| WP_002275430.1 | type II CRISPR RNA-guided endonuclease Cas9 [Streptococcus mutans] | SEQ ID NO: 229 |
| WP_002276448.1 | type II CRISPR RNA-guided endonuclease Cas9 [Streptococcus mutans] | SEQ ID NO: 230 |
| WP_002277050.1 | type II CRISPR RNA-guided endonuclease Cas9 [Streptococcus mutans] | SEQ ID NO: 231 |
| WP_002773364.1 | type II CRISPR RNA-guided endonuclease Cas9 [Streptococcus mutans] | SEQ ID NO: 232 |
| WP_002279025.1 | type II CRISPR RNA-guided endonuclease Cas9 [Streptococcus mutans] | SEQ ID NO: 233 |
| WP_002279859.1 | type II CRISPR RNA-guided endonuclease Cas9 [Streptococcus mutans] | SEQ ID NO: 234 |
| WP_002280230.1 | type II CRISPR RNA-guided endonuclease Cas9 [Streptococcus mutans] | SEQ ID NO: 235 |
| WP_002281696.1 | type II CRISPR RNA-guided endonuclease Cas9 [Streptococcus mutans] | SEQ ID NO: 236 |
| WP_002282247.1 | type II CRISPR RNA-guided endonuclease Cas9 [Streptococcus mutans] | SEQ ID NO: 237 |
| WP_002282906.1 | type II CRISPR RNA-guided endonuclease Cas9 [Streptococcus mutans] | SEQ ID NO: 238 |
| WP_002283846.1 | type II CRISPR RNA-guided endonuclease Cas9 [Streptococcus mutans] | SEQ ID NO: 239 |
| WP_002872255.1 | type II CRISPR RNA-guided endonuclease Cas9 [Streptococcus mutans] | SEQ ID NO: 240 |
| WP_002288990.1 | type II CRISPR RNA-guided endonuclease Cas9 [Streptococcus mutans] | SEQ ID NO: 241 |
| WP_002289641.1 | type II CRISPR RNA-guided endonuclease Cas9 [Streptococcus mutans] | SEQ ID NO: 242 |
| WP_002290427.1 | type II CRISPR RNA-guided endonuclease Cas9 [Streptococcus mutans] | SEQ ID NO: 243 |
| WP_002295753.1 | type II CRISPR RNA-guided endonuclease Cas9 [Streptococcus mutans] | SEQ ID NO: 244 |
| WP_002296423.1 | type II CRISPR RNA-guided endonuclease Cas9 [Streptococcus mutans] | SEQ ID NO: 245 |
| WP_002304487.1 | type II CRISPR RNA-guided endonuclease Cas9 [Streptococcus mutans] | SEQ ID NO: 246 |
| WP_002305844.1 | type II CRISPR RNA-guided endonuclease Cas9 [Streptococcus mutans] | SEQ ID NO: 247 |
| WP_002307203.1 | type II CRISPR RNA-guided endonuclease Cas9 [Streptococcus mutans] | SEQ ID NO: 248 |
| WP_002310390.1 | type II CRISPR RNA-guided endonuclease Cas9 [Streptococcus mutans] | SEQ ID NO: 249 |
| WP_002352408.1 | type II CRISPR RNA-guided endonuclease Cas9 [Streptococcus mutans] | SEQ ID NO: 250 |
| WP_012997688.1 | type II CRISPR RNA-guided endonuclease Cas9 [Streptococcus mutans] | SEQ ID NO: 251 |
| WP_014677909.1 | type II CRISPR RNA-guided endonuclease Cas9 [Streptococcus mutans] | SEQ ID NO: 252 |
| WP_019312892.1 | type II CRISPR RNA-guided endonuclease Cas9 [Streptococcus mutans] | SEQ ID NO: 253 |
| WP_019313659.1 | type II CRISPR RNA-guided endonuclease Cas9 [Streptococcus mutans] | SEQ ID NO: 254 |
| WP_019314093.1 | type II CRISPR RNA-guided endonuclease Cas9 [Streptococcus mutans] | SEQ ID NO: 255 |

| Accession | Description | SEQ ID NO |
|---|---|---|
| WP_019315370.1 | type II CRISPR RNA-guided endonuclease Cas9 [Streptococcus mutans] | SEQ ID NO: 256 |
| WP_019803776.1 | type II CRISPR RNA-guided endonuclease Cas9 [Streptococcus mutans] | SEQ ID NO: 257 |
| WP_019805234.1 | type II CRISPR RNA-guided endonuclease Cas9 [Streptococcus mutans] | SEQ ID NO: 258 |
| WP_024783594.1 | type II CRISPR RNA-guided endonuclease Cas9 [Streptococcus mutans] | SEQ ID NO: 259 |
| WP_024784288.1 | type II CRISPR RNA-guided endonuclease Cas9 [Streptococcus mutans] | SEQ ID NO: 260 |
| WP_024784666.1 | type II CRISPR RNA-guided endonuclease Cas9 [Streptococcus mutans] | SEQ ID NO: 261 |
| WP_024784894.1 | type II CRISPR RNA-guided endonuclease Cas9 [Streptococcus mutans] | SEQ ID NO: 262 |
| WP_024786433.1 | type II CRISPR RNA-guided endonuclease Cas9 [Streptococcus mutans] | SEQ ID NO: 263 |
| WP_049473442.1 | CRISPR-associated protein Csn1 [Streptococcus mutans] | SEQ ID NO: 264 |
| WP_049474547.1 | CRISPR-associated protein Csn1 [Streptococcus mutans] | SEQ ID NO: 265 |
| EMC03581.1 | hypothetical protein SMU69_09359 [Streptococcus mutans NLML4] | SEQ ID NO: 266 |
| WP_000428612.1 | type II CRISPR RNA-guided endonuclease Cas9 [Streptococcus oralis] | SEQ ID NO: 267 |
| WP_000428613.1 | type II CRISPR RNA-guided endonuclease Cas9 [Streptococcus oralis] | SEQ ID NO: 268 |
| WP_049523028.1 | CRISPR-associated protein Csn1 [Streptococcus parasanguinis] | SEQ ID NO: 269 |
| WP_003107102.1 | type II CRISPR RNA-guided endonuclease Cas9 [Streptococcus parauberis] | SEQ ID NO: 270 |
| WP_054279288.1 | type II CRISPR RNA-guided endonuclease Cas9 [Streptococcus phocae] | SEQ ID NO: 271 |
| WP_049531101.1 | CRISPR-associated protein Csn1 [Streptococcus pseudopneumoniae] | SEQ ID NO: 272 |
| WP_049538452.1 | CRISPR-associated protein Csn1 [Streptococcus pseudopneumoniae] | SEQ ID NO: 273 |
| WP_049549711.1 | CRISPR-associated protein Csn1 [Streptococcus pseudopneumoniae] | SEQ ID NO: 274 |
| WP_007896501.1 | type II CRISPR RNA-guided endonuclease Cas9 [Streptococcus pseudoporcinus] | SEQ ID NO: 275 |
| EFR44625.1 | CRISPR-associated protein, Csn1 family [Streptococcus pseudoporcinus SPIN 20026] | SEQ ID NO: 276 |
| WP_002897477.1 | type II CRISPR RNA-guided endonuclease Cas9 [Streptococcus sanguinis] | SEQ ID NO: 277 |
| WP_002906454.1 | type II CRISPR RNA-guided endonuclease Cas9 [Streptococcus sanguinis] | SEQ ID NO: 278 |
| WP_009729476.1 | type II CRISPR RNA-guided endonuclease Cas9 [Streptococcus sp. F0441] | SEQ ID NO: 279 |
| CQR24647.1 | CRISPR-associated protein [Streptococcus sp. FF10] | SEQ ID NO: 280 |
| WP_000066813.1 | type II CRISPR RNA-guided endonuclease Cas9 [Streptococcus sp. M334] | SEQ ID NO: 281 |
| WP_009754323.1 | type II CRISPR RNA-guided endonuclease Cas9 [Streptococcus sp. taxon 056] | SEQ ID NO: 282 |

| Accession | Description | SEQ ID NO |
|---|---|---|
| WP_044674937.1 | type II CRISPR RNA-guided endonuclease Cas9 [Streptococcus suis] | SEQ ID NO: 283 |
| WP_044676715.1 | type II CRISPR RNA-guided endonuclease Cas9 [Streptococcus suis] | SEQ ID NO: 284 |
| WP_044680361.1 | type II CRISPR RNA-guided endonuclease Cas9 [Streptococcus suis] | SEQ ID NO: 285 |
| WP_044681799.1 | type II CRISPR RNA-guided endonuclease Cas9 [Streptococcus suis] | SEQ ID NO: 286 |
| WP_049533112.1 | CRISPR-associated protein Csn1 [Streptococcus suis] | SEQ ID NO: 287 |
| WP_029090905.1 | type II CRISPR RNA-guided endonuclease Cas9 [Brochothrix thermosphacta] | SEQ ID NO: 288 |
| WP_006506696.1 | type II CRISPR RNA-guided endonuclease Cas9 [Catenibacterium mitsuokai] | SEQ ID NO: 289 |
| AIT42264.1 | Cas9hc:NLS:HA [Cloning vector pYB196] | SEQ ID NO: 290 |
| WP_034440723.1 | type II CRISPR endonuclease Cas9 [Clostridiales bacterium S5-A11] | SEQ ID NO: 291 |
| AKQ21048.1 | Cas9 [CRISPR-mediated gene targeting vector p(bhsp68-Cas9)] | SEQ ID NO: 292 |
| WP_004636532.1 | type II CRISPR RNA-guided endonuclease Cas9 [Dolosigranulum pigrum] | SEQ ID NO: 293 |
| WP_002364836.1 | MULTISPECIES: type II CRISPR RNA-guided endonuclease Cas9 [Enterococcus] | SEQ ID NO: 294 |
| WP_016631044.1 | MULTISPECIES: type II CRISPR RNA-guided endonuclease Cas9 [Enterococcus] | SEQ ID NO: 295 |
| EMS75795.1 | hypothetical protein H318_06676 [Enterococcus durans IPLA 655] | SEQ ID NO: 296 |
| WP_002373311.1 | type II CRISPR RNA-guided endonuclease Cas9 [Enterococcus faecalis] | SEQ ID NO: 297 |
| WP_002378009.1 | type II CRISPR RNA-guided endonuclease Cas9 [Enterococcus faecalis] | SEQ ID NO: 298 |
| WP_002407324.1 | type II CRISPR RNA-guided endonuclease Cas9 [Enterococcus faecalis] | SEQ ID NO: 299 |
| WP_002413717.1 | type II CRISPR RNA-guided endonuclease Cas9 [Enterococcus faecalis] | SEQ ID NO: 300 |
| WP_010775580.1 | type II CRISPR RNA-guided endonuclease Cas9 [Enterococcus faecalis] | SEQ ID NO: 301 |
| WP_010818269.1 | type II CRISPR RNA-guided endonuclease Cas9 [Enterococcus faecalis] | SEQ ID NO: 302 |
| WP_010824395.1 | type II CRISPR RNA-guided endonuclease Cas9 [Enterococcus faecalis] | SEQ ID NO: 303 |
| WP_016622645.1 | type II CRISPR RNA-guided endonuclease Cas9 [Enterococcus faecalis] | SEQ ID NO: 304 |
| WP_033624816.1 | type II CRISPR RNA-guided endonuclease Cas9 [Enterococcus faecalis] | SEQ ID NO: 305 |
| WP_033625576.1 | type II CRISPR RNA-guided endonuclease Cas9 [Enterococcus faecalis] | SEQ ID NO: 306 |
| WP_037891179.1 | type II CRISPR RNA-guided endonuclease Cas9 [Enterococcus faecalis] | SEQ ID NO: 307 |
| WP_002310644.1 | type II CRISPR RNA-guided endonuclease Cas9 [Enterococcus faecium] | SEQ ID NO: 308 |
| WP_002312694.1 | type II CRISPR RNA-guided endonuclease Cas9 [Enterococcus faecium] | SEQ ID NO: 309 |

| Accession | Description | SEQ ID |
|---|---|---|
| WP_002314015.1 | type II CRISPR RNA-guided endonuclease Cas9 [Enterococcus faecium] | SEQ ID NO: 310 |
| WP_002320716.1 | type II CRISPR RNA-guided endonuclease Cas9 [Enterococcus faecium] | SEQ ID NO: 311 |
| WP_002330729.1 | type II CRISPR RNA-guided endonuclease Cas9 [Enterococcus faecium] | SEQ ID NO: 312 |
| WP_002335161.1 | type II CRISPR RNA-guided endonuclease Cas9 [Enterococcus faecium] | SEQ ID NO: 313 |
| WP_002345439.1 | type II CRISPR RNA-guided endonuclease Cas9 [Enterococcus faecium] | SEQ ID NO: 314 |
| WP_034867970.1 | type II CRISPR RNA-guided endonuclease Cas9 [Enterococcus faecium] | SEQ ID NO: 315 |
| WP_047937432.1 | type II CRISPR RNA-guided endonuclease Cas9 [Enterococcus faecium] | SEQ ID NO: 316 |
| WP_010720994.1 | type II CRISPR RNA-guided endonuclease Cas9 [Enterococcus hirae] | SEQ ID NO: 317 |
| WP_010737004.1 | type II CRISPR RNA-guided endonuclease Cas9 [Enterococcus hirae] | SEQ ID NO: 318 |
| WP_034700478.1 | type II CRISPR RNA-guided endonuclease Cas9 [Enterococcus hirae] | SEQ ID NO: 319 |
| WP_007209003.1 | type II CRISPR RNA-guided endonuclease Cas9 [Enterococcus italicus] | SEQ ID NO: 320 |
| WP_023519017.1 | type II CRISPR RNA-guided endonuclease Cas9 [Enterococcus mundtii] | SEQ ID NO: 321 |
| WP_010770040.1 | type II CRISPR RNA-guided endonuclease Cas9 [Enterococcus phoeniculicola] | SEQ ID NO: 322 |
| WP_048604708.1 | type II CRISPR RNA-guided endonuclease Cas9 [Enterococcus sp. AM1] | SEQ ID NO: 323 |
| WP_010750235.1 | type II CRISPR RNA-guided endonuclease Cas9 [Enterococcus villorum] | SEQ ID NO: 324 |
| AII16583.1 | Cas9 endonuclease [Expression vector pCas9] | SEQ ID NO: 325 |
| WP_029073316.1 | type II CRISPR RNA-guided endonuclease Cas9 [Kandleria vitulina] | SEQ ID NO: 326 |
| WP_031589969.1 | type II CRISPR RNA-guided endonuclease Cas9 [Kandleria vitulina] | SEQ ID NO: 327 |
| KDA45870.1 | CRISPR-associated protein Cas9/Csn1, subtype II/NMEMI [Lactobacillus animalis] | SEQ ID NO: 328 |
| WP_039099354.1 | type II CRISPR RNA-guided endonuclease Cas9 [Lactobacillus curvatus] | SEQ ID NO: 329 |
| AKP02966.1 | hypothetical protein ABB45_04605 [Lactobacillus farciminis] | SEQ ID NO: 330 |
| WP_010991369.1 | type II CRISPR RNA-guided endonuclease Cas9 [Listeria innocua] | SEQ ID NO: 331 |
| WP_033838504.1 | type II CRISPR RNA-guided endonuclease Cas9 [Listeria innocua] | SEQ ID NO: 332 |
| EHN60060.1 | CRISPR-associated protein, Csn1 family [Listeria innocua ATCC 33091] | SEQ ID NO: 333 |
| EFR89594.1 | crispr-associated protein, Csn1 family [Listeria innocua FSL 54-378] | SEQ ID NO: 334 |
| WP_038409211.1 | type II CRISPR RNA-guided endonuclease Cas9 [Listeria ivanovii] | SEQ ID NO: 335 |
| EFR95520.1 | crispr-associated protein Csn1 [Listeria ivanovii FSL F6-596] | SEQ ID NO: 336 |

-continued

| | | | |
|---|---|---|---|
| WP_003723650.1 | type II CRISPR RNA-guided endonuclease Cas9 [Listeria monocytogenes] | SEQ ID NO: 337 | |
| WP_003727705.1 | type II CRISPR RNA-guided endonuclease Cas9 [Listeria monocytogenes] | SEQ ID NO: 338 | |
| WP_003730785.1 | type II CRISPR RNA-guided endonuclease Cas9 [Listeria monocytogenes] | SEQ ID NO: 339 | |
| WP_003733029.1 | type II CRISPR RNA-guided endonuclease Cas9 [Listeria monocytogenes] | SEQ ID NO: 340 | |
| WP_003739838.1 | type II CRISPR RNA-guided endonuclease Cas9 [Listeria monocytogenes] | SEQ ID NO: 341 | |
| WP_014601172.1 | type II CRISPR RNA-guided endonuclease Cas9 [Listeria monocytogenes] | SEQ ID NO: 342 | |
| WP_023548323.1 | type II CRISPR RNA-guided endonuclease Cas9 [Listeria monocytogenes] | SEQ ID NO: 343 | |
| WP_031665337.1 | type II CRISPR RNA-guided endonuclease Cas9 [Listeria monocytogenes] | SEQ ID NO: 344 | |
| WP_031669209.1 | type II CRISPR RNA-guided endonuclease Cas9 [Listeria monocytogenes] | SEQ ID NO: 345 | |
| WP_033920898.1 | type II CRISPR RNA-guided endonuclease Cas9 [Listeria monocytogenes] | SEQ ID NO: 346 | |
| AKI42028.1 | CRISPR-associated protein [Listeria monocytogenes] | SEQ ID NO: 347 | |
| AKI50529.1 | CRISPR-associated protein [Listeria monocytogenes] | SEQ ID NO: 348 | |
| EFR83390.1 | crispr-associated protein Csn1 [Listeria monocytogenes FSL F2-208] | SEQ ID NO: 349 | |
| WP_046323366.1 | type II CRISPR RNA-guided endonuclease Cas9 [Listeria seeligeri] | SEQ ID NO: 350 | |
| AKE81011.1 | Cas9 [Plant multiplex genome editing vector pYLCRISPR/Cas9Pubi-H] | SEQ ID NO: 351 | |
| CU082355.1 | Uncharacterized protein conserved in bacteria [Roseburia hominis] | SEQ ID NO: 352 | |
| WP_033162887.1 | type II CRISPR RNA-guided endonuclease Cas9 [Sharpea azabuensis] | SEQ ID NO: 353 | |
| AGZ01981.1 | Cas9 endonuclease [synthetic construct] | SEQ ID NO: 354 | |
| AKA60242.1 | nuclease deficient Cas9 [synthetic construct] | SEQ ID NO: 355 | |
| AKS40380.1 | Cas9 [Synthetic plasmid pFC330] | SEQ ID NO: 356 | |
| 4UN5_B | Cas9, Chain B, Crystal Structure | SEQ ID NO: 357 | |
| WP_010922251 | 1 MDKK-YSIGLDIGTNSVGWAVITDEYKVPSKKFKVLGNTDRHSIKKNLIGALLFDSGETA--EATRLKTARRRYT | | 73 |
| WP_039695303 | 1 MTKKnYSIGLDIGTNSVGWAVITDDYKVPAKKMKVLGNTDKKYIKKNLLGALLFDGALLFDGALLFDSGETA--EATRLKTARRRYT | | 74 |
| WP_045635197 | 1 K-KG-YSIGLDIGTNSVGFAVITDDYKVPSKKMKVLGNTDKRFIKKNLIGALLFDEGTTA--EARRLKTARRRYT | | 73 |
| 5AXW_A | 1 MKRN-YILGLDIGITSVGYGII--DYET--------GVRLFKEANVEnnEGRRSKRGARRLKR | | 61 |
| WP_009880683 | ---------------------------RDVIDA--GVRLFKEANVEnnEGRRSKRGARRLKR | | |
| WP_010922251 | 1 MDKK-YSIGLDIGTNSVGWAVITDDYKVPSKKFKVLGNTDRHSIKKNLIGALLFDSGETA--EATRLKTARRRYT | | 73 |
| WP_011054416 | 1 MDKK-YSIGLDIGTNSVGWAVITDDYKVPSKKFKVLGNTDRHGIKKNLIGALLFDSGETA--EATRLKTARRRYT | | 73 |
| WP_011284745 | 1 MDKK-YSIGLDIGTNSVGWAVITDDYKVPSKKLKLGLGNTDRHSIKKNLIGALLFDSGETA--EATRLKTARRRYT | | 73 |
| WP_011285506 | 1 MDKK-YSIGLDIGTNSVGWAVITDDYKVPSKKFKVLGNTDRHSIKKNLIGALLFDSGETA--EATRLKTARRRYT | | 73 |
| WP_011527619 | 1 MDKK-YSIGLDIGTNSVGWAVITDDYKVPSKKFKVLGNTDRHSIKKNLIGALLFDSGEIA--EATRLKTARRRYT | | 73 |

-continued

| | | | |
|---|---|---|---|
| WP_012560673 | 1 | MDKK-YSIGLDIGTNSVGWAVITDDYKVPSKKFKVLGNTDRHSIKKNLIGALLFDSGETA--EATRLKRTARRRYT | 73 |
| WP_014407541 | 1 | MDKK-YSIGLDIGTNSVGWAVITDDYKVPSKKFKVLGNTDRHSIKKNLIGALLFGSGETA--EATRLKRTARRRYT | 73 |
| WP_020905136 | 1 | MDKK-YSIGLDIGTNSVGWAVITDDYKVPSKKFKVLGNTDRHSIKKNLIGALLFDSGETA--EATRLKRTARRRYT | 73 |
| WP_023080005 | 1 | MDKK-YSIGLDIGTNSVGWAVITDDYKVPSKKFKVLGNTDRHGIKKNLIGALLFDSGETA--EATRLKRTARRRYT | 73 |
| WP_023610282 | 1 | MDKK-YSIGLDIGTNSVGWAVITDDYKVPSKKLKVLGNTDRHGIKKNLIGALLFDSGETA--EATRLKRTARRRYT | 73 |
| WP_030125963 | 1 | MDKK-YSIGLDIGTNSVGWAVITDDYKVPSKKFKVLGNTDRHSIKKNLIGALLFDSGETA--EATRLKRTARRRYT | 73 |
| WP_030126706 | 1 | MDKK-YSIGLDIGTNSVGWAVITDDYKVPSKKFKVLGNTDRHGIKKNLIGALLFDSGETA--EATRLKRTARRRYT | 73 |
| WP_031488318 | 1 | MDKK-YSIGLDIGTNSVGWAVITDDYKVPSKKFKVLGNTDRHSIKKNLIGALLFDSGETA--EATRLKRTARRRYT | 73 |
| WP_032460140 | 1 | MDKK-YSIGLDIGTNSVGWAVITDDYKVPSKKFKVLGNTDRHSIKKNLIGALLFDSGETA--EATRLKRTARRRYT | 73 |
| WP_032461047 | 1 | MDKK-YSIGLDIGTNSVGWAVITDDYKVPSKKFKVLGNTDRHSIKKNLIGALLFDSGETA--EATRLKRTARRRYT | 73 |
| WP_032462016 | 1 | MDKK-YSIGLDIGTNSVGWAVITDDYKVPSKKFKVLGNTDRHSIKKNLIGALLFDSGETA--EATRLKRTARRRYT | 73 |
| WP_032462936 | 1 | MDKK-YSIGLDIGTNSVGWAVITDDYKVPSKKFKVLGNTDRHSIKKNLIGALLFDSGETA--EATRLKRTARRRYT | 73 |
| WP_032464890 | 1 | MDKK-YSIGLDIGTNSVGWAVITDDYKVPSKKFKVLGNTDRHSIKKNLIGALLFDSGETA--EATRLKRTARRRYT | 73 |
| WP_033888930 | 1 | ------------------------------------------------------------------------- | |
| WP_038431314 | 1 | MDKK-YSIGLDIGTNSVGWAVITDDYKVPSKKFKVLGNTDRHSIKKNLIGALLFDSGETA--EATRLKRTARRRYT | 73 |
| WP_038432938 | 1 | MDKK-YSIGLDIGTNSVGWAVITDDYKVPSKKFKVLGNTDRHSIKKNLIGALLFDSGETA--EATRLKRTARRRYT | 73 |
| WP_038434062 | 1 | MDKK-YSIGLDIGTNSVGWAVITDDYKVPSKKFKVLGNTDRHSIKKNLIGALLFDSGETA--EATRLKRTARRRYT | 73 |
| BAQ51233 | | ------------------------------------------------------------------------- | |
| KGE60856 | | ------------------------------------------------------------------------- | |
| KGE60162 | | ------------------------------------------------------------------------- | |
| WP_002989955 | 1 | MDKK-YSIGLDIGTNSVGWAVITDDYKVPSKKFKVLGNTDRHSIKKNLIGALLFDSGEIA--EATRLKRTARRRYT | 73 |
| WP_003030002 | 1 | MDQK-YSIGLDIGTNSVGWAVVTDDYKVPSKKMKVLGNTDKQSIKKNLIGALLFDSGETA--EATRLKRTARRRYT | 73 |
| WP_003065552 | 1 | MTKKnYSIGLDIGTNSVGWAVITDDYKVPAKKIRVLGNTDKEYIKKNLIGALLFDGGNTA--ADRRLKRTARRRYT | 74 |
| WP_001040076 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040078 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040080 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040081 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040083 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040085 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040087 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040088 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040089 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040090 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040091 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040092 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040094 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040095 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040096 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040097 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040098 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040099 | 1 | MNKP-YSIGLDIGTNSVGYSVVTDDYKVPAKKMRVLGNTDKEYIKKNLIGALLFDGGNTA--ADRRLKRTARRRYT | 73 |
| WP_001040100 | 1 | MNKP-YSIGLDIGTNSVGYSVVTDDYKVPAKKMRVLGNTDKEYIKKNLIGALLFDGGNTA--ADRRLKRTARRRYT | 73 |
| WP_001040104 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040105 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040106 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040107 | 1 | MNKP-YSIGLDIGTNSVGWSIITDDYKVPAKKMRVLGNTDKEYIKKNLIGALLFDGGNTA--ADRRLKRTARRRYT | 73 |
| WP_001040108 | 1 | MNKP-YSIGLDIGTNSVGWSIITDDYKVPAKKMRVLGNTDKEYIKKNLIGALLFDGGNTA--SDRRLKRTARRRYT | 73 |
| WP_001040109 | 1 | MNKP-YSIGLDIGTNSVGWSIITDDYKVPAKKMRVLGNTDKEYIKKNLIGALLFDGGNTA--SDRRLKRTARRRYT | 73 |
| WP_001040110 | 1 | MNKP-YSIGLDIGTNSVGWSIITDDYKVPAKKMRVLGNTDKEYIKKNLIGALLFDGGNTA--SDRRLKRTARRRYT | 73 |
| WP_015058523 | 1 | MNKP-YSIGLDIGTNSVGWSIITDDYKVPAKKMRVLGNTDKEYIKKNLIGALLFDGGNTA--ADRRLKRTSRRRYT | 73 |
| WP_017643650 | 1 | MNKP-YSIGLDIGTNSVGWSIITDDYKVPAKKMRVLGNTDKEYIKKNLIGALLFDGGNTA--ADRRLKRTARRRYT | 73 |
| WP_017647151 | 1 | MNKP-YSIGLDIGTNSVGWSIITDDYKVPAKKMRVLGNTDKEYIKKNLIGALLFDGGNTA--SDRRLKRTARRRYT | 73 |
| WP_017648376 | 1 | MNKP-YSIGLDIGTNSVGWSIITDDYKVPAKKMRVLGNTDKEYIKKNLIGALLFDGGNTA--SDRRLKRTARRRYT | 73 |
| WP_017649527 | 1 | MNKP-YSIGLDIGTNSVGWSIITDDYKVPAKKMRVLGNTDKEYIKKNLIGALLFDGGNTA--ADRRLKRTARRRYT | 73 |

```
WP_017771611       1  MNKP-YSIGLDIGTNSVGYSVVTDDYKVPAKKMRVLGNTDKEYIKKNLLGALLFDGGNTA--SDRRLKRTARRYT  73
WP_017771984       1  MNKP-YSIGLDIGTNSVGWSIITDDYKVPAKKMRVLGNTDKEYIKKNLIGALLFDGGNTA--ADRRLKRTARRYT  73
CFQ25032           1  MNKP-YSIGLDIGTNSVGWSIITDDYKVPAKKMRVLGNTDKEYIKKNLIGALLFDGGNTA--ADRRLKRTARRYT  73
CFV16040           1  MNKP-YSIGLDIGTNSVGWSIITDDYKVPAKKMRVLGNTDKEYIKKNLIGALLFDGGNTA--ADRRLKRTARRYT  73
KLJ37842           1  MNKP-YSIGLDIGTNSVGWSIITDDYKVPAKKMRVLGNTDKEYIKKNLIGALLFDGGNTA--ADRRLKRTARRYT  73
KLJ72361           1  MNKP-YSIGLDIGTNSVGWSIITDDYKVPAKKMRVLGNTDKEYIKKNLIGALLFDGGNTA--ADRRLKRTARRYT  73
KLL20707           1  MNKP-YSIGLDIGTNSVGWSIITDDYKVPAKKMRVLGNTDKEYIKKNLIGALLFDGGNTA--ADRRLKRTARRYT  73
KLL42645           1  MNKP-YSIGLDIGTNSVGYSVVTDDYKVPAKKMRVLGNTDKEYIKKNLIGALLFDGGNTA--SDRRLKRTARRYT  73
WP_047207273       1  MNKP-YSIGLDIGTNSVGWSIITDDYKVPAKKMRVLGNTDKEYIKKNLIGALLFDGGNTA--ADRRLKRTARRYT  73
WP_047209694       1  MNKP-YSIGLDIGTNSVGWSIITDDYKVPAKKMRVLGNTDKEYIKKNLIGALLFDGGNTA--ADRRLKRTARRYT  73
WP_050198062       1  MNKP-YSIGLDIGTNSVGWSIITDDYKVPAKKMRVLGNTDKEYIKKNLIGALLFDGGNTA--ADRRLKRTARRYT  73
WP_050201642       1  MNKP-YSIGLDIGTNSVGWSIITDDYKVPAKKMRVLGNTDKERIKKNLIGALLEDGGNTA--ADRRLKRTARRYT  73
WP_050204027       1  MNKP-YSIGLDIGTNSVGYSVVTDDYKVPAKKMRVLGNTDKEYIKKNLIGALLFDGGNTA--SDRRLKRTARRYT  73
WP_050881965       1  MNKP-YSIGLDIGTNSVGWSIITDDYKVPAKKMRVLGNTDKEYIKKNLIGALLEDGGNTA--ADRRLKRTARRYT  73
WP_050886065       1  MNKP-YSIGLDIGTNSVGWSIITDDYKVPAKKMRVLGNTDKEYIKKNLIGALLFDGGNTA--ADRRLKRTARRYT  73
AHN30376           1  MNKP-YSIGLDIGTNSVGWSIITDDYKVPAKKMRVLGNTDKEYIKKNLIGALLEDGGNTA--ADRRLKRIARRYT  73
EAO78426           1  MNKP-YSIGXDIGTNSVGWSIITDDYKVPAKKMRVLGNTDKEYIKKNLIGALLEDGGNTA--ADRRLKRTARRYT  73
CCW42055           1  MNQK-YSIGLDIGTNSVGWSIITDDYKVPAKKMKVLGNTDKQSIKKKNLLGALLEDSGETA--EATRLKRTARRYT  73
WP_003041502       1  MKKE-YSIGLDIGTNSVGWAVITDDYKVPAKKMKVLGNTDKQSIKKKNLLGALLEDSGETA--EATRLKRTARRYT  74
WP_037593752       1  MKKE-YSIGLDIGTNSVGWAVITDDYKVPAKKMKVLGNTDKEYIKKNLLGALLFDSGETA--EATRLKRTARRYT  73
WP_049516684       1  MKKE-YSIGLDIGTNSVGWAVITDDYKVPAKKMKVLGNTDKEYIKKNLIGALLFDSGETA--EATRLKRTARRYT  74
GAD46167           1  MTKKnYSIGLDIGTNSVGWAVITDDYKVPAKKMKVLGNTDKKYIKKNLIGALLFDSGETA--EATRLKRTARRYT  74
WP_018363470       1  MEKK-YSIGLDIGTNSVGWAVITDDYKVPSKKFKVLGNTNRKSIKKKNLMGALLFDSGETA--EATRLKRTARRYT  73
WP_003043819       1  MGKP-YSIGLDIGTNSVGWAVITDDYKVPSKKFKVLGNTDKQSIKKKNLLGALLFDSGETA--EATRLKRTARRYT  73
WP_006269658       1  MTQK-YSIGLDIGTNSVGWAIVTDDYKVPSKKFKVLGNTNKQYIKKNLLGALLFDSGETA--KATRLKRTARRYT  73
WP_048800889       1  MDKK-YSIGLDIGTNSVGWAVITDDYKVPSKKFKVLGNTDRHSIKKKNLIGALLFDSGETA--EATRLKRTARRYT  73
WP_012767106       1  MDKK-YSIGLDIGTNSVGWAVITDDYKVPSKKFKVLGNTDRHSIKKKNLIGALLFDSGETA--EATRLKRTARRYT  73
WP_014612333       1  MDKK-YSIGLDIGTNSVGWAVITDDYKVPSKKFKVLGNTDRHSIKKKNLIGALLFDSGETA--EATRLKRTARRYT  73
WP_015017095       1  MDKK-YSIGLDIGTNSVGWAVITDDYKVPKKMKVLGNTERKTIKKNLIGALLEDSGDTA--EGTRLKRTARRYT  73
WP_015057649       1  MDKK-YSIGLDIGTNSVGWAVITDDYKVRVPTKKMKVLGNTERKTIKKNLIGALLEDSGDTA--EGTRLKRTARRYT  73
WP_048272215       1  MKKP-YTIALDIGTNSVGWNVVVTDDYKVRVPTKKMKVLGNTERKTIKKNLIGALLEDSGDTA--EGTRLKRAARRYT  73
WP_049519324       1  MKKP-YTIALDIGTNSVGWAVITDDYKVPAKKMKVLGNTDKKYIKKNLIGALLFDSGETA--EATRLKRAARRYT  73
WP_012515931       1  MKKP-YTIALDIGTNSVGWAVITDDYKVPAKKMKVLGNTDKKYIKKNLIGALLFDSGETA--EATRLKRTARRYT  73
WP_021320964       1  M-EKtYSIGLDIGTNSVGWAVITDDYKVPAKKMKVLGNTDKKYIKKNLIGALLFDSGETA--EATRLKRTARRYT  73
WP_037581760       1  MKKP-YTIALDIGTNSVGWAVITDDYKVPAKKMKVLGNTDKKYIKKNLIGALLEDGETA--EATRLKRTARRYT  74
WP_004232481       1  MTKKnYSIGLDIGTNSVGWAVITDDYKVPAKKMKVLGNTDKKYIKKNLIGALLFDSGETA--EATRLKRTARRYT  74
WP_009854540       1  MTKKnYSIGLDIGTNSVGWAVITDDYKVPAKKMKVLGNTDKKYIKKNLIGALLFDSGETA--EATRLKRTARRYT  74
WP_012962174       1  MTEKnYSIGLDIGTNSVGWAVITDDYKVPAKKMKVLGNTDKKYIKKNLIGALLEDNGETA--EATRLKRTARRYT  74
WP_039695303       1  MTKKnYSIGLDIGTNSVGWAVITDDYKVPAKKMKVLGNTDKKYIKKNLIGALLEDNGETA--EVTRLKRTARRYT  73
WP_014334983       1  M-EKsYSIGLDIGTNSVGWAVITDDYKVPAKKMRIQGTTDRTSIKKNLIGALLEDNGETA--EATRLKRTTRRYT  73
WP_003099269       1  MRKP-YSIGLDIGTNSVGWAVITDDYKVPAKKMRIQGTTDRTSIKKNLIGALLEDNGETA--EATRLKRTTRRYT  73
AHY15608           1  MRKP-YSIGLDIGTNSVGWAVVTDDYKVPAKKMRIQGTTDRTSIKKNLIGALLEDNGETA--EATRLKRTTRRYT  73
AHY17476           1  -----------------------------------------------------------  
ESR09100           1  MRKP-YSIGLDIGTNSVGWAVITDDYKVPSKKMRIQGTTDRTSIKKNLLGALLEDNGETA--EATRLKRTTRRYT  73
AGM98575           1  MKKP-YSIGLDIGTNSVGWAVITDDYKVPSKKMKVLGNTDKSHIKKNLIGALLEDSGETA--EDRRLKRTARRYT  73
ALF27331           1  MKKP-YSIGLDIGTNSVGWAVVMEDYKVPSKKMKVLGNTDKQSIKKKNLIGALLEDSGETAv-ERRLNRTTSRRYD  74
WP_018372492       1  NNKP-YSIGLDIGTNSVGFAVITDDYKVPSKKMKVLGNTDKKHFIKKNLIGALLFDEGTTA--EARRLKRTARRYT  73
WP_045618028       1  K-KG-YSIGLDIGTNSVGWAVITDDYKVPSKKMKVLGNTDKSHIEKNLIGALLEKNLLA--EARRLKRTARRYT  74
WP_046351197       1  MKKP-YSIGLDIGTNSVGWAVITDDYKVPAKKMKVLGNTDKSHIEKNLIGALLEDSGNTA--EDRRLKRTARRYT  73
WP_002263549       1  MKKP-YSIGLDIGTNSVGWAVVTDDYKVPAKKMKVLGNTDKSHIKKNLIGALLEDSGNTA--EDRRLKRTARRYT  73
WP_002263887       1  MKKP-YSIGLDIGTNSVGWAVVTDDYKVPAKKMKVLGNTDKSHIKKNLIGALLEDSGNTA--EDRRLKRTARRYT  73
WP_002269043       1  MKKP-YSIGLDIGTNSVGWAVVTDDYKVPAKKMKVLGNTDKSHIKKNLIGALLEDSGNTA--EDRRLKRTARRYT  73
WP_002269448       1  MKKP-YSIGLDIGTNSVGWAVVTDDYKVPAKKMKVLGNTDKSHIKKNLIGALLEDSGNTA--EDRRLKRTARRYT  73
```

-continued

| ID | Sequence | Len |
|---|---|---|
| WP_002271977 | MKKP-YSIGLDIGTNSVGWAVTDDYKVPAKKMKVLGNTDKSHIKKNLLGALLFDSGNTA--EDRRLKRTARRYT | 73 |
| WP_002272766 | MKKP-YSIGLDIGTNSVGWAVTDDYKVPAKKMKVLGNTDKSHIKKNLLGALLFDSGNTA--EDRRLKRTARRYT | 73 |
| WP_002273241 | MKKP-YSIGLDIGTNSVGWAVTDDYKVPAKKMKVLGNTDKSHIKKNLLGALLFDSGNTA--EDRRLKRTARRYT | 73 |
| WP_002275430 | MKKP-YSIGLDIGTNSVGWAVTDDYKVPAKKMKVLGNTDKSHIKKNLLGALLFDSGNTA--ADRRLKRTARRYT | 73 |
| WP_002276448 | MKKP-YSIGLDIGTNSVGWAVTDDYKVPAKKMKVLGNTDKSHIKKNLLGALLFDSGNTA--EDRRLKRTARRYT | 73 |
| WP_002277050 | MKKP-YSIGLDIGTNSVGWAVTDDYKVPAKKMKVLGNTDKSHIKKNLLGALLFDSGNTA--EDRRLKRTARRYT | 73 |
| WP_002277364 | MKKS-YSIGLDIGTNSVGWAVTDDYKVPAKKMKVLGNTDKSHIKKNLLGALLFDSGNTA--ADRRLKRTARRYT | 73 |
| WP_002279025 | MKKP-YSIGLDIGTNSVGWAVTDDYKVPAKKMKVLGNTDKSHIKKNLLGALLFDSGNTA--ADRRLKRTARRYT | 73 |
| WP_002279859 | MKKP-YSIGLDIGTNSVGWAVTDDYKVPAKKMKVLGNTDKSHIKKNLLGALLFDSGNTA--EDRRLKRTARRYT | 73 |
| WP_002280230 | MKKP-YSIGLDIGTNSVGWAVTDDYKVPAKKMKVLGNTDKSHIKKNLLGALLFDSGNTA--ADRRLKRTARRYT | 73 |
| WP_002281696 | MKKP-YSIGLDIGTNSVGWAVTDDYKVPAKKMKVLGNTDKSHIKKNLLGALLFDSGNTA--EDRRLKRTARRYT | 73 |
| WP_002282247 | MKKP-YSIGLDIGTNSVGWAVTDDYKVPAKKMKVLGNTDKSHIKKNLLGALLFDSGNTA--EDRRLKRTARRYT | 73 |
| WP_002282906 | MKKP-YSIGLDIGTNSVGWSVTDDYKVPAKKMKVLGNTDKSHIKKNLLGALLFDSGNTA--EDRRLKRTARRYT | 73 |
| WP_002283846 | MKKP-YSIGLDIGTNSVGWAVTDDYKVPAKKMKVLGNTDKSHIKKNLLGALLFDSGNTA--EDRRLKRTARRYT | 73 |
| WP_002287255 | MKKP-YSIGLDIGTNSVGWAVTDDYKVSAKKMKVLGNTDKSHIKKNLLGALLFDSGNTA--EDRRLKRTARRYT | 73 |
| WP_002288990 | MKKP-YSIGLDIGTNSVGWAVTDDYKVPAKKMKVLGNTDKSHIKKNLLGALLFDSGNTA--EDRRLKRTARRYT | 73 |
| WP_002289641 | MKKP-YSIGLDIGTNSVGWAVTDDYKVPAKKMKVLGNTDKSHIKKNLLGALLFDSGNTA--EDRRLKRTARRYT | 73 |
| WP_002290427 | MKKP-YSIGLDIGTNSVGWAVTDDYKVPAKKMKVLGNTDKSHIKKNLLGALLFDSGNTA--EDRRLKRTARRYT | 73 |
| WP_002295753 | MKKP-YSIGLDIGTNSVGWAVTDDYKVPDKKMKVLGNTDKSHIKKNLLGALLFDSGNTA--EDRRLKRTARRYT | 73 |
| WP_002296423 | MKKP-YSIGLDIGTNSVGWAVTDDYKVPAKKMKVLGNTDKSHIEKNLLGALLFDSGNTA--EDRRLKRTARRYT | 73 |
| WP_002304487 | MKKP-YSIGLDIGTNSVGWAVTDDYKVPAKKMKVLGNTDKSHIKKNLLGALLFDSGNTA--EDRRLKRTARRYT | 73 |
| WP_002305844 | MKKP-YSIGLDIGTNSVGWAVTDDYKVPAKKMKVLGNTDKSHIKKNLLGALLFDSGNTA--EDRRLKRTARRYT | 73 |
| WP_003072203 | MKKP-YSIGLDIGTNSVGWAVTDDYKVPAKKMKVLGNTDKSHIKKNLLGALLFDSGNTA--EDRRLKRTARRYT | 73 |
| WP_002310390 | MKKP-YSIGLDIGTNSVGWAVTDDYKVPAKKMKVLGNTDKSHIEKNLLGALLFDSGNTA--EDRRLKRTARRYT | 73 |
| WP_002352408 | MKKP-YSIGLDIGTNSVGWAVTDDYKVPAKKMKVLGNTDKSHIKKNLLGALLFDSGNTA--EDRRLKRTARRYT | 73 |
| WP_012997688 | MKKP-YSIGLDIGTNSVGWAVTDDYKVPAKKMKVLGNTDKSHIKKNLLGALLFDSGNTA--EDRRLKRTARRYT | 73 |
| WP_014677909 | MKKP-YSIGLDIGTNSVGWAVTDDYKVPAKKMKVLGNTDKSHIKKNLLGALLFDSGNTA--ADRRLKRTARRYT | 73 |
| WP_019312892 | MKKP-YSIGLDIGTNSVGWAVTDDYKVPAKKMKVLGNTDKSHIKKNLLGALLFDSGNTA--ADRRLKRTARRYT | 73 |
| WP_019313659 | MKKP-YSIGLDIGTNSVGWAVTDDYKVPAKKMKVLGNTDKSHIKKNLLGALLFDSGNTA--EDRRLKRTTRRYT | 73 |
| WP_019314093 | MKKP-YSIGLDIGTNSVGWAVTDDYKVPAKKMKVLGNTDKSHIKKNLLGALLFDSGNTA--EDRRLKRTARRYT | 73 |
| WP_019315370 | MKKP-YSIGLDIGTNSVGWAVTDDYKVPAKKMKVLGNTDKSHIKKNLLGALLFDSGNTA--EDRRLKRTARRYT | 73 |
| WP_019803776 | MKKP-YSIGLDIGTNSVGWAVTDDYKVPAKKMKVLGNTDKSHIKKNLLGALLFDSGNTA--EDRRLKRTARRYT | 73 |
| WP_019805234 | MKKP-YSIGLDIGTNSVGWAVTDDYKVPAKKMKVLGNTDKSHIKKNLLGALLFDSGNTA--ADRRLKRTARRYT | 73 |
| WP_024783594 | MKKP-YSIGLDIGTNSVGWAVTDDYKVPAKKMKVLGNTDKSHIKKNLLGALLFDSGNTA--EDRRLKRTARRYT | 73 |
| WP_024784288 | MKKP-YSIGLDIGTNSVGWAVTDDYKVPAKKMKVLGNTDKSHIKKNLLGALLFDSGNTA--ADRRLKRTARRYT | 73 |
| WP_024784666 | MKKP-YSIGLDIGTNSVGWAVTDDYKVPAKKMKVLGNTDKSHIKKNLLGALLFDSGNTA--EDRRLKRTTRRYT | 73 |
| WP_024784894 | MKKP-YSIGLDIGTNSVGWAVTDDYKVPAKKMKVLGNTDKSHIKKNLLGALLFDSGNTA--ADRRLKRTARRYT | 73 |
| WP_024786433 | MKKP-YSIGLDIGTNSVGWAVTDDYKVPAKKMKVLGNTDKSHIKKNLLGALLFDSGNTA--ADRRLKRTARRYT | 73 |
| WP_049473442 | MKKP-YSIGLDIGTNSVGWAVTDDYKVPAKKMKVLGNTDKSHIKKNLLGALLFDSGNTA--ADRRLKRTARRYT | 73 |
| WP_049745547 | MKKP-YSIGLDIGTNSVGWAVTDDYKVPAKKMKVLGNTDKSHIKKNLLGALLFDSGNTA--ADRRLKRTARRYT | 73 |
| EMC03581 | MDL------IGTNSVGWAVTDDYKVPAKKMKVLGNTDKSHIKKNLLGALLFDSGNTA--ADRRLKRTARRYT | 66 |
| WP_000428612 | ENKN-YSIGLDIGTNSVGWAVITDDYKVPAKKMKVLGNTDKRFIKKNLLGALLFDEGTTA--EARRLKRTARRYT | 74 |
| WP_000428613 | ENKN-YSIGLDIGTNSVGWSVITDDYKVPAKKMKVLGNTDKRFIKKNLLGALLFDEGTTA--EARRLKRTARRYT | 74 |
| WP_049523028 | K-KP-YSIGLDIGTNSVGWAVITDDYKVPAKKMKVLGNTNKESIKKNLLGALLFDSGETA--ADRRLKRTARRYT | 73 |
| WP_003107102 | ---------MKVLGNTDRQTVKKNMIGTLLFDSGETA--EARRLKRTARRYT | 42 |
| WP_054279288 | -KKS-YSIGLDIGTNSVGWAVITDDYKVSKKNMIGALLFDEGPA--ASTRVKRTRRRYT | 75 |
| WP_049531101 | SNKP-YSIGLDIGTNSVGWNVIITDDYKVPSKKMKVLGNTDKHFIKKNLLGALLFDEGTTA--EDRRLKRTARRYT | 74 |
| WP_049538452 | SNKP-YSIGLDIGTNSVGWAVITDDYKVPSKKMKVLGNTDKHFIKKNLLGALLFDEGTTA--EDRRLKRTARRYT | 74 |
| WP_049549711 | SNKP-YSIGLDIGTNSVGWAVITDDYKVPAKKMKVLGNTDRKTIKKNLLGTVLFDSGETA--EDRRLKRTARRYT | 74 |
| WP_007896501 | --YS-YSIGLDIGTNSVGWAVINEDYKVPAKKMTVFGNTDKTIKKNLLGTLLFDSGETA--QARRLKRTNRRYT | 75 |
| EFR44625 | MLGTVLFDSGETA--QARRLKRTNRRYT | 27 |
| WP_002897477 | K-KP-YSIGLDIGTNSVGWAVITDDYKVPSKKMKVLGNTDKHFIKKNLLGALLFDEGTTA--ESRRLKRTARRYT | 73 |
| WP_002906454 | K-KP-YSIGLDIGTNSVGWAVITDDYKVPSKKMKVLGNTDKHFIKKNLLGALLFDEGTTA--EDRRLKRTSRRYT | 73 |
| WP_009729476 | ENKN-YSIGLDIGTNSVGWSVITDDYKVPSKKMKVLGNTDKHFIKKNLLGALLFDEGTTA--EARRLKRTARRYT | 74 |

```
-continued

CQR24647          1  MKKP-YSIGLDIGTNSVGWSVVTDDYKVPAKKMKVLGNTDKEYIKKNLIGALLFDSGETA--EATRMKRTARRRYT   73
WP_000066813      1  SNKS-YSIGLDIGTNSVGWNAVITDDYKVPSSKKMKVLGNTDKHFIKKNLIGALLFDEGTA--EDRRLKRTARRRYT   74
WP_009754323      1  NNNN-YAIGLDIGTNSVGWAVITDDYKVPSKKMRVLGNTDKRFIKKNLIGALLFDEGTA--EDRRLKRTARRRYT    74
WP_044674937      1  MKKK-YAIGLDIGTNSVGWNAVITDDYKVPSKKMKVFGNTEKRYIKKNLLGTLLFDEGNTA--ENRRLKRTARRRYT  73
WP_044676715      1  MKKK-YAIGLDIGTNSVGWNSVVTDDYKVPSKKMKVFGNTEKRYIKKNLLGTLLFDEGNTA--ENRRLKRTARRRYT  73
WP_044680361      1  MKKK-YAIGIDIGTNSVGWSVVTDDYKVPSKKMKVFGNTEKRYIKKNLLGTLLFDEGNTA--ENRRLKRTARRRYT   73
WP_044681799      1  MKKK-YAIGIDIGTNSVGWNAVITDDYKVPSKKMSVFGNTEKRYIKKNLLGTLLFDEGNTA--ENRRLKRTARRRYT  73
WP_049533112      1  MKKK-YSIGLDIGTNSVGWNAVITDDYKVPSKKMKVLGNTDKQSIKKNLLGALLFDEGETA--EATRLKRTARRRYT  73
WP_029090905      1  MDQK-YSIGLDIGTNSVGWPAKKMKVLGNTDKQSIKKNLLGALLFDEGETA--ABRRGYRSTRRRLN           73
WP_006506696      1  ----------------------------MWGVSLFEAGKTA--ANRRASRSIRRRYN                    27
AIT42264          1  I-VD-YCIGLDLGTGSVGNAVVDMNHRLMKRN-----------GKHLWGSRLFSNAETA--EATRLKRTARRRYT   60
WP_034440723      1  MDKK-YSIGLDIGTNSVGNAVITDEYKVPSKKFKVLGNTDRHSIKKNLIGALLFDSGETA--EATRLKRTARRRYT   73
AKQ21048          1  -MKN-YTIGLDIGTNSVGNAVIKDDLTLVRKKIKISGNTDKKEVKKNLWGSFLFEQGDTA--QDTRVKRIARRRYE  73
WP_004636532      1  MDKK-YSIGLDIGTNSVGNAVITDEYKVPSKKFKVLGNTDRHSIKKNLIGALLFDSGETA--EATRLKRTARRRYT   73
WP_002364836      1  MQKN-YTIGLDIGTNSVGNAVMKDDYTLIRKRMVLGNTDIKKLKKNFWGVRLFDEGETA--KETRLKRGTRRRYQ   73
WP_016631044      1  MKKD-YVIGLDIGTNSVGWNAVMTEDYQLVKKKMPIYGNTEKKLFEEGHTA--EDRRLKRTARRRIS           73
EMS75795          1  ----------------------------MRLFEEGHTA--EDRRLKRTARRRIS                       24

WP_002373311      1  MKKD-YVIGLDIGTNSVGWAVMTEDYQLVKKKMPIYGNTEKKKIKKNFWGVRLFEEGHTA--EDRRLKRTARRRIS  73
WP_002378009      1  MKKD-YVIGLDIGTNSVGWAVMTEDYQLVKKKMPIYGNTEKKKIKKNFWGVRLFEEGHTA--EDRRLKRTARRRIS  73
WP_002407324      1  MKKD-YVIGLDIGTNSVGWAVMTEDYQLVKKKMPIYGNTEKKKIKKNFWGVRLFEEGHTA--EDRRLKRTARRRIS  73
WP_002413717      1  MKKD-YVIGLDIGTNSVGWAVMTEDYQLVKKKMPIYGNTEKKKIKKNFWGVRLFEEGHTA--EDRRLKRTARRRIS  73
WP_010775580      1  MKKD-YVIGLDIGTNSVGWAVMTEDYQLVKKKMPIYGNTEKKKIKKNFWGVRLFEEGHTA--EDRRLKRTARRRIS  73
WP_010818269      1  MKKD-YVIGLDIGTNSVGWAVMTEDYQLVKKKMPIYGNTEKKKIKKNFWGVRLFEEGHTA--EDRRLKRTARRRIS  73
WP_010824395      1  MKKD-YVIGLDIGSNSVGWAVMTEDYQLVKKKMPIYGNTEKKKIKKNFWGVRLFEEGHTA--EDRRLKRTARRRIS  73
WP_016622245      1  MKKD-YVIGLDIGTNSVGWAVMTEDYQLVKKKMPIYGNTEKKKIKKNFWGVRLFEEGHTA--EDRRLKRTARRRIS  73
WP_033624816      1  MKKD-YVIGLDIGTNSVGWAVMTEDYQLVKKKMPIYGNTEKKKIKKNFWGVRLFEEGHTA--EDRRLKRTARRRIS  73
WP_033625576      1  MKKD-YVIGLDIGTNSVGWAVMTEDYQLVKKKMPIYGNTEKKKIKKNFWGVRLFEEGHTA--EDRRLKRTARRRIS  73
WP_033789179      1  MKKD-YVIGLDIGTNSVGWAVMTEDYQLVKKKMPIYGNTEKKKIKKNFWGVRLFEEGHTA--EDRRLKRTARRRIS  73
WP_002310644      1  MKKE-YTIGLDIGTNSVGWSVLTDDYRLVSKKMVAGNTEKSSTKKNFWGVRLFDEGQTA--EARRSKRTARRRLA   73
WP_002112694      1  MKKE-YTIGLDIGTNSVGWSVLTDDYRLVSKKMVAGNTEKSSTKKNFWGVRLFDEGQTA--EARRSKRTARRRLA   73
WP_002114015      1  MKKE-YTIGLDIGTNSVGWSVLTDDYRLVSKKMVAGNTEKSSTKKNFWGVRLFDEGQTA--EARRSKRTARRRLA   73
WP_002320716      1  MKKE-YTIGLDIGTNSVGWSVLTDDYRLVSKKMVAGNTEKSSTKKNFWGVRLFDEGQTA--EARRSKRTARRRLA   73
WP_002330729      1  MKKE-YTIGLDIGTNSVGWSVLTDDYRLVSKKMVAGNTEKSSTKKNFWGVRLFDEGQTA--EARRSKRTARRRLA   73
WP_002351161      1  MKKE-YTIGLDIGTNSVGWSVLTDDYRLVSKKMVAGNTEKSSTKKNFWGVRLFDEGQTA--EARRSKRTARRRLA   73
WP_002345439      1  MKKE-YTIGLDIGTNSVGWSVLTDDYRLVSKKMVAGNTEKSSTKKNFWGVRLFDEGQTA--EARRSKRTARRRLA   73
WP_034867970      1  MTKD-YTIGLDIGTNSVGWSVLTDDYQLMKRKMSVHGNTEKKKIKKNFWGARLFDEGQTA--EPRRTKRTNRRRLA   73
WP_047937432      1  MKKE-YTIGLDIGTNSVGWSVLTDDYRLVSKKMVAGNTEKSSTKKNFWGVRLFDEGQTA--EARRSKRTARRRLA   73
WP_010720994      1  MTKD-YTIGLDIGTNSVGWSVLTDDYQLMKRKMSVHGNTEKKKIKKNFWGARLFDEGQTA--EPRRTKRTNRRRLA  73
WP_010737004      1  MTKD-YTIGLDIGTNSVGWSVLTDDYQLMKRKMSVHGNTEKKKIKKNFWGARLFDEGQTA--EPRRTKRTNRRRLA  73
WP_034700478      1  MTKD-YTIGLDIGTNSVGWSVLTDDYQLMKRKMSVHGNTEKKKIKKNFWGARLFDEGQTA--EPRRTKRTNRRRLA  73
WP_072009003      1  MKND-YTIGLDIGTNSVGYSVVTDDYKVISKKMNVFGNTEKKSIKKNFWGVRLFESGQTA--QEARMKRTSRRRIA  73
WP_023519017      1  MEKE-YTIGLDIGTNSVGWAVLTDDYRLVARKMSIQGDSNRKKNFWGARLFEEGKTA--QFRRIKRTNRRRIA     73
WP_010770040      1  MKKE-YTIGLDIGTNSVGWAVLTENYDLVKKKMVYGNTETKYLKKNLVKKNFWGVRLFDEGETA--ADRRLKRTTRRRYS  73
WP_048604708      1  MGKE-YTIGLDIGTNSVGWAVLVQEDLDLVRRKMVYGNTEKKLVYKKNFWGVDLFDEGMTA--KDTRLKRTTRRRYF    73
WP_010750235      1  MNKA-YTLGLDIGTNSVGWAVVTDDYRLMAKKMPVHSKMEKKKIKKNFWGARLFDEGQTA--EERRNKRATRRRLR   73
AII16583          1  ADKK-YSIGLDIGTNSVGWAVITDDYEYKVPSKKFKVLGNTDRHSIKKNLIGALLFDSGETA--EATRLKRTARRRYT  112
WP_029073316      1  NNKI-YNIGLDIGDASVGWAVVDEHYNLLKRH-----------GKHMWGSRLFTQANTA--VERRSSRTRRRYN     65
WP_031589969      1  NNKI-YNIGLDIGDASVGHAVVTDDYKVPTKKKNMLGVLLFNEGQTA--ADTRLKRGARRRYT                65
KDA45870          1  LKKD-YSIGLDIGTNSVGHAVVTDDYKVPTSKKTIKKNMLGVLLFNEGQTA--ADTRLKRGARRRYT             74
WP_039099354      1  MSRP-YNIGLDIGTSSIGNSVVDDQSKLVSVR-----------KKNLWGVRLFEGAQTA--AERRSFRTRRRLK      61
AKP02966          1  KEQP-YNIGLDIGTGSVGWAVTNDNYDLLNIK-----------KKNLWGVRLFEGAQTA--KETRLNRSTRRRYR    64
WP_010991369      1  MKKP-YTIGLDIGTNSVGWAVLTDQYDLVRKKMKIAGDSEKKQIKKNFWGVRLFDEGQTA--ADRRMARTARRRIE   73
WP_033838504      1  MKKP-YTIGLDIGTNSVGWAVLTDQYDLVRKKMKIAGDSEKKQIKKNFWGVRLFDEGQTA--ADRRMARTARRRIE   73
EHN60060          1  MKKP-YTIGLDIGTNSVGWAVLTDQYDLVRKMKIAGDSEKKQIKKNFWGVRLFDEGQTA--ADRRMARTARRRIE    76
```

```
EFR89594          -------------------------------------------------------------------------
WP_038409211    1 MRKP-YTIGLDIGTNSVGWAVLTDQYNLVRKMKVAGSAEKKQIKKNFWGVRLFDEGEVA--AGRRMNRTRRRIE  73
EFR95520          -------------------------------------------------------------------------
WP_003723650    1 MKNP-YTIGLDIGTNSVGWAVLTDQYDLVRKMKVAGNSDKKQIKKNFWGVRLFDDGQTA--VDRRMNRTARRIE  73
WP_003727705    1 MKNP-YTIGLDIGTNSVGWAVLTDQYDLVRKMKVAGNSDKKQIKKNFWGVRLFDDGQTA--VDRRMNRTARRIE  73
WP_003730785    1 MKNP-YTIGLDIGTNSVGWAVLTDQYDLVRKMKVAGNSDKKQIKKNFWGVRLFDDGQTA--VDRRMNRTARRIE  73
WP_003733029    1 MKKP-YTIGLDIGTNSVGWAVLTDQYDLVRKMKISGDSEKKQIKKNFWGVRLFEKGETA--AKRRMSRTARRIE  73
WP_003739838    1 MKNP-YTIGLDIGTNSVGWAVLTDQYDLVRKMKVAGNSDKKQIKKNFWGVRLFDEGETA--ADRRMNRTARRIE  73
WP_014601172    1 MKNP-YTIGLDIGTNSVGWAVLTNQYDLVRKMKVAGNSDKKQIKKNFWGVRLFDDGQTA--VDRRMNRTARRIE  73
WP_023548323    1 MKNP-YTIGLDIGTNSVGWAVLTNQYDLVRKMKVAGNSDKKQIKKNFWGVRLFDDGQTA--VDRRMNRTARRIE  73
WP_031665337    1 MKKP-YTIGLDIGTNSVGWAVLTDQYDLVRKMKISGDSEKKQIKKNFWGVRLFEKGETA--AKRRMSRTARRIE  73
WP_031669209    1 MKNP-YTIGLDIGTNSVGWAVLTDQYDLVRKMKVAGNSDKKQIKKNFWGVRLFEKGETA--VDRRMNRTARRIE  73
WP_033920898    1 MKNP-YTIGLDIGTNSVGWAVLTDQYDLVRKMKVAGNSDKKQIKKNFWGVRLFDDGQTA--VDRRMNRTARRIE  73
AKI42028        1 MKNP-YTIGLDIGTNSVGWAVLTNQYDLVRKMKVAGNSDKKQIKKNFWGVRLFDDGQTA--VDRRMNRTARRIE  76
AKI50529        1 MKNP-YTIGLDIGTNSVGWAVLTNQYDLVRKMKVAGNSDKKQIKKNFWGVRLFDDGQTA--VDRRMNRTARRIE  76
EFR83390          -------------------------------------------------------------------------
WP_046323366    1 MKKP-YTIGLDIGTNSVGWAALTDQYDLVRKRMKVAGNSEKKQIKKNLMGVRLVDEGKTA--AHRRVNRTRRRIE  73
AKE81011        1 ADKK-YSIGLDIGTNSVGWAVITDEYKVPSKKFKVLGNTDRHSIKKNLIGALLFDSGETA--EATRLKRTARRYT  89
CUO02355        1 I-VD-YCIGLDLGTCSVGWAVVDMNHRLMKRN--------GKHLWGSRLFSNAETA--ATRRSSRSIRRRYN    64
WP_031162887    1 KDIR-YSIGLDIGTNSVGWAVMDEHYELLKKG---------NHHMWGSRLFDAAEPA--ATRRASRSIRRRYN   65
AGZ01981        1 ADKK-YSIGLDIGTNSVGWAVITDEYKVPSKKFKVLGNTDRHSIKKNLIGALLFDSGETA--EATRLKRTARRYT 106
AKA60242        1 MDKK-YSIGLAIGTNSVGWAVITDEYKVPSKKFKVLGNTDRHSIKKNLIGALLFDSGETA--EATRLKRTARRYT  73
AKS40380        1 MDKK-YSIGLAIGTNSVGWAVITDEYKVPSKKFKVLGNTDRHSIKKNLIGALLFDSGETA--EATRLKRTARRYT  73
4UN5_B          1 MDKK-YSIGLAIGTNSVGWAVITDEYKVPSKKFKVLGNTDRHSIKKNLIGALLFDSGETA--EATRLKRTARRYT  77

WP_010922251   74 RRKNRICYLQEIFSNEMAKVDDSFFHRLEE-SFLV--EEDKK---H         ERHPIFGNIV-DEVAYHEKYPTIVLRKKHLV 143

WP_039695303   75 RRKNRLRYLQEIFANEIAKVDESFQRLDE-SFLT-DDDKT---F         DSHPIFGNKA-EEDAYHQKFPTIYHLRKHLA 144
WP_045635197   74 RRKNRLRYLQEIFSBEMSKVDSSFFHRLDD-SFLI-PEDKR---E         SKYPIFATLT-EEKEYHKQFPTIYHLRKQLA 143
5AXW_A         62 RRRHRIQRVKKLLFD--------YNLLTDhSELS---------G         --NPYEARVK-----------GLSQKLS    104
WP_009880683      -----------------------------------------         --------------------------------
WP_010922251   74 RRKNRICYLQEIFSNEMAKVDDSFFHRLEE-SFLV--EEDKK---H         ERHPIFGNIV-DEVAYHEKYPTIYHLRKKLV 143
WP_011054416   74 RRKNRICYLQEIFSNEMAKVDDSFFHRLEE-SFLV--EEDKK---H         ERHPIFGNIV-DEVAYHEKYPTIYHLRKKLA 143
WP_011284745   74 RRKNRICYLQEIFSNEMAKVDDSFFHRLEE-SFLV--EEDKK---H         ERHPIFGNIV-DEVAYHEKYPTIYHLRKKLA 143
WP_011285506   74 RRKNRICYLQEIFSNEMAKVDDSFFHRLEE-SFLV--EEDKK---H         ERHPIFGNIV-DEVAYHEKYPTIYHLRKKLV 143
WP_011527619   74 RRKNRICYLQEIFSNEIAKVDDSFFHRLEE-SFLV--EEDKK---H         ERHPIFGNIV-DEVAYHEKYPTIYHLRKKLV 143
WP_012560673   74 RRKNRICYLQEIFSNEIAKVDDSFFHRLEE-SFLV--EEDKK---H         ERHPIFGNIV-DEVAYHEKYPTIYHLRKKLV 143
WP_014407541   74 RRKNRICYLQEIFSNEMAKVDDSFFHRLEE-SFLV--EEDKK---H         ERHPIFGNIV-DEVAYHEKYPTIYHLRKKLA 143
WP_020905136   74 RRKNRICYLQEIFSNEMAKVDDSFFHRLEE-SFLV--EEDKK---H         ERHPIFGNIV-DEVAYHEKYPTIYHLRKKLA 143
WP_023080005   74 RRKNRICYLQEIFSNEMAKVDDSFFHRLEE-SFLV--EEDKK---H         ERHPIFGNIV-DEVAYHEKYPTIYHLRKKLA 143
WP_023610282   74 RRKNRICYLQEIFSNEMAKVDDSFFHRLEE-SFLV--EEDKK---H         ERHPIFGNIV-DEVAYHEKYPTIYHLRKKLA 143
WP_030125963   74 RRKNRICYLQEIFSNEMAKVDDSFFHRLEE-SFLV--EEDKK---H         ERHPIFGNIV-DEVAYHEKYPTIYHLRKKLA 143
WP_030126706   74 RRKNRICYLQEIFSNEMAKVDDSFFHRLEE-SFLV--EEDKK---H         ERHPIFGNIV-DEVAYHEKYPTIYHLRKKLA 143
WP_031488318   74 RRKNRICYLQEIFSNEMAKVDDSFFHRLEE-SFLV--EEDKK---H         ERHPIFGNIV-DEVAYHEKYPTIYHLRKKLA 143
WP_032461047   74 RRKNRICYLQEIFSNEIAKVDDSFFHRLEE-SFLV--EEDKK---H         ERHPIFGNIV-DEVAYHEKYPTIYHLRKKLA 143
WP_032462016   74 RRKNRICYLQEIFSNEMAKVDDSFFHRLEE-SFLV--EEDKK---H         ERHPIFGNIV-DEVAYHEKYPTIYHLRKKLA 143
WP_032462936   74 RRKNRICYLQEIFSNEMAKVDDSFFHRLEE-SFLV--EEDKK---H         ERHPIFGNIV-DEVAYHEKYPTIYHLRKKLA 143
WP_032464890   74 RRKNRICYLQEIFSNEMAKVDDSFFHRLEE-SFLV--EEDKK---H         ERHPIFGNIV-DEVAYHEKYPTIYHLRKKLA 143
WP_033888930     ------------------MAKVDDSFFHRLEE-SFLV--EEDKK---H         ERHPIFGNIV-DEVAYHEKYPTIYHLRKKLV 143
WP_038431314   74 RRKNRICYLQEIFSNEMAKVDDSFFHRLEE-SFLV--EEDKK---H         ERHPIFGNIV-DEVAYHEKYPTIYHLRKKLA 143
WP_038432938   74 RRKNRICYLQEIFSNEMAKVDDSFFHRLEE-SFLV--EEDKK---H         ERHPIFGNIV-DEVAYHEKYPTIYHLRKKLA 143
WP_038434062   74 RRKNRICYLQEIFSNEMAKVDDSFFHRLEE-SFLV--EEDKK---H         ERHPIFGNIV-DEVAYHEKYPTIYHLRKKLA 143
BAQ51233        1 ----------------MAKVDDSFFHRLEE-SFLV--EEDKK---H         ERHPIFGNIV-DEVAYHEKYPTIYHLRKKLV  54
```

-continued

```
KGE60162                                                                                                                                
KGE60856          RRRNRICYLQEIFSNEMAKVDDSFPHRLEE-SFLV--EEDKK---H  ERHPIFGNIV-DEVAYHEKYPTIYHRKKLV                      143
WP_002989955   74 RRRNRLRYLQEIFAEEMNKVDENFQRLDD-SFLV--DEDKR---G  ERHPIFGNIA-AEVKYHDDFPTIYHLRKHLA                      143
WP_003030002   74 RRRNRLRYLQEIFAEEMTKVDESFPQRLDE-SFLRwdDDNKK---L GRYPIFGNKA-DVVKYHQEFPTIYHLRKHLA                      146
WP_003065552   75 RRRNRILYLQEIFAEEMSKVDDSFPHRLED-SFLV--EEDKR---G SKYPIFATLQ-EEKYYHEKFPTIYHLRKELA                      143
WP_001040076   74 RRRNRILYLQEIFAEEMSKVDDSFPHRLED-SFLV--EEDKR---G SKYPIFATLQ-EEKDYHEKFPTIYHLRKELA                      143
WP_001040078   74 RRRNRILYLQEIFAEEMSKVDDSFPHRLED-SFLV--EEDKR---G SKYPIFATLQ-EEKDYHEKFSTIYHLRKELA                      143
WP_001040080   74 RRRNRILYLQEIFAEEMSKVDDSFPHRLED-SFLV--EEDKR---G SKYPIFATLQ-EEKDYHEKFPTIYHLRKELA                      143
WP_001040081   74 RRRNRILYLQEIFAEEMSKVDDSFPHRLED-SFLV--EEDKR---G SKYPIFATLQ-EEKDYHEKFSTIYHLRKELA                      143
WP_001040083   74 RRRNRILYLQEIFAEEMSKVDDSFPHRLED-SFLV--EEDKR---G SKYPIFATLQ-EEKDYHEKFSTIYHLRKELA                      143
WP_001040085   74 RRRNRILYLQEIFAEEMSKVDDSFPHRLED-SFLV--EEDKR---G SKYPIFATLQ-EEKDYHEKFPTIYHLRKELA                      143
WP_001040087   74 RRRNRILYLQEIFAEEMSKVDDSFPHRLED-SFLV--EEDKR---G SKYPIFATLQ-EEKDYHEKFSTIYHLRKELA                      143
WP_001040088   74 RRRNRILYLQEIFAEEMSKVDDSFPHRLED-SFLV--EEDKR---G SKYPIFATLQ-EEKDYHEKFPTIYHLRKELA                      143
WP_001040089   74 RRRNRILYLQEIFAEEMSKVDDSFPHRLED-SFLV--EEDKR---G SKYPIFATLQ-EEKDYHEKFSTIYHLRKELA                      143
WP_001040090   74 RRRNRILYLQEIFAEEMSKVDDSFPHRLED-SFLV--EEDKR---G SKYPIFATLQ-EEKDYHEKFPTIYHLRKELA                      143
WP_001040091   74 RRRNRILYLQEIFAEEMSKVDDSFPHRLED-SFLV--EEDKR---G SKYPIFATLQ-EEKDYHEKFPTIYHLRKELA                      143
WP_001040092   74 RRRNRILYLQEIFAEEMSKVDDSFPHRLED-SFLV--EEDKR---G SKYPIFATMQ-EEKDYHEKFPTIYHLRKELA                      143
WP_001040094   74 RRRNRILYLQEIFAEEMSKVDDSFPHRLED-SFLV--EEDKR---G SKYPIFATMQ-EEKYYHEKFPTIYHLRKELA                      143
WP_001040095   74 RRRNRILYLQEIFAEEMSKVDDSFPHRLED-SFLV--EEDKR---G SKYPIFATMQ-EEKDYHEKFSTIYHLRKELA                      143
WP_001040096   74 RRRNRILYLQEIFAEEMSKVDDSFPHRLED-SFLV--EEDKR---G SKYPIFATMQ-EEKDYHEKFPTIYHLRKELA                      143
WP_001040097   74 RRRNRILYLQEIFAEEMSKVDDSFPHRLED-SFLV--EEDKR---G SKYPIFATMQ-EEKDYHEKFPTIYHLRKELA                      143
WP_001040098   74 RRRNRILYLQEIFAEEMSKVDDSFPHRLED-SFLV--EEDKR---G SKYPIFATMQ-EEKDYHEKFPTIYHLRKELA                      143
WP_001040099   74 RRRNRILYLQEIFAEEMSKVDDSFPHRLED-SFLV--EEDKR---G SKYPIFATMQ-EEKYYHEKFPTIYHLRKELA                      143
WP_001040100   74 RRRNRILYLQEIFAEEMSKVDDSFPHRLED-SFLV--EEDKR---G SKYPIFATMQ-EEKDYHEKFPTIYHLRKELA                      143
WP_001040104   74 RRRNRILYLQEIFAEEMSKVDDSFPHRLED-SFLV--EEDKR---G SKYPIFATMQ-EEKDYHEKFSTIYHLRKELA                      143
WP_001040105   74 CRRNRILYLQEIFAEEMSKVDDSFPHRLED-SFLV--EEDKR---G SKYPIFATMQ-EEKDYHEKFSTIYHLRKELA                      143
WP_001040106   74 RRRNRILYLQEIFAEEMSKVDDSFPHRLED-SFLV--EDDKR---G SKYPIFATMQ-EEKDYHEKFPTIYHLRKELA                      143
WP_001040107   74 RRRNRILYLQEIFAEEMSKVDDSFPHRLED-SFLV--EDDKR---G SKYPIFATMQ-EEKDYHEKFPTIYHLRKELA                      143
WP_001040108   74 RRRNRILYLQEIFAEEMSKVDDSFPHRLED-SFLV--EEDKR---G SKYPIFATMQ-EEKDYHEKFPTIYHLRKELA                      143
WP_001040109   74 RRRNRILYLQEIFAEEMSKVDDSFPHRLED-SFLV--EEDKR---G SKYPIFATMQ-EEKDYHEKFPTIYHLRKELA                      143
WP_001040110   74 RRRNRILYLQEIFAEEMSKVDDSFPHRLED-SFLV--EEDKR---G SKYPIFATMQ-EEKDYHEKFPTIYHLRKELA                      143
WP_015058523   74 RRRNRILYLQEIFAEEMSKVDDSFPHRLED-SFLV--EEDKR---G SKYPIFATMQ-EEKDYHEKFPTIYHLRKELA                      143
WP_017643650   74 RRRNRILYLQEIFAEEMSKVDDSFPHRLED-SFLV--EEDKR---G SKYPIFATMQ-EEKDYHEKFPTIYHLRKELA                      143
WP_017647151   74 RRRNRILYLQEIFAEEMSKVDDSFPHRLED-SFLV--EEDKR---G SKYPIFATMQ-EEKDYHEKFPTIYHLRKELA                      143
WP_017648376   74 RRRNRILYLQEIFAEEMSKVDDSFPHRLED-SFLV--EEDKR---G SKYPIFATMQ-EEKDYHEKFPTIYHLRKELA                      143
WP_017649527   74 RRRNRILYLQEIFAEEMSKVDDSFPHRLED-SFLV--EEDKR---G SKYPIFATMQ-EEKDYHEKFPTIYHLRKELA                      143
WP_017771611   74 RRRNRILYLQEIFAEEMSKVDDSFPHRLED-SFLV--EEDKR---G SKYPIFATMQ-EEKDYHEKFPTIYHLRKELA                      143
WP_017771984   74 RRRNRILYLQEIFAEEMSKVDDSFPHRLED-SFLV--EEDKR---G SKYPIFATMQ-EEKDYHEKFPTIYHLRKELA                      143
CFQ25032       74 RRRNRILYLQEIFAEEMSKVDDSFPHRLED-SFLV--EEDKR---G SKYPIFATMQ-EEKDYHEKFPTIYHLRKELA                      143
CFV16040       74 RRRNRILYLQEIFAEEMSKVDDSFPHRLED-SFLV--EEDKR---G SKYPIFATMQ-EEKDYHEKFPTIYHLRKELA                      143
KLJ37842       74 RRRNRILYLQEIFAEEMSKVDDSFPHRLED-SFLV--EEDKR---G SKYPIFATMQ-EEKDYHEKFPTIYHLRKELA                      143
KLJ72361       74 RRRNRILYLQEIFAEEMSKVDDSFPHRLED-SFLV--EEDKR---G SKYPIFATMQ-EEKDYHEKFPTIYHLRKELA                      143
KLL20707       74 RRRNRILYLQEIFAEEMSKVDDSFPHRLED-SFLV--EEDKR---G SKYPIFATMQ-EEKDYHEKFPTIYHLRKELA                      143
KLL42645       74 RRRNRILYLQEIFAEEMSKVDDSFPHRLED-SFLV--EEDKR---G SKYPIFATMQ-EEKDYHEKFSTIYHLRKELA                      143
WP_047202273   74 RRRNRILYLQEIFAEEMSKVDDSFPHRLED-SFLV--EEDKR---G SKYPIFATMQ-EEKDYHEKFPTIYHLRKELA                      143
WP_047209694   74 RRRNRILYLQEIFAEEMSKVDDSFPHRLED-SFLV--EEDKR---G SKYPIFATMQ-EEKDYHEKFPTIYHLRKELA                      143
WP_050198062   74 RRRNRILYLQEIFAEEMSKVDDSFPHRLED-SFLV--EEDKR---G SKYXIFATMQ-EEKDYHEKFSTIYHLRKELA                      143
WP_050201642   74 RRRNRILYLQEIFAEEMSKVDDSFPHRLED-SFLV--EEDKR---G SKYPIFATMQ-EEKDYHEKFPTIYHLRKELA                      143
WP_050204027   74 RRRNRILYLQEIFAEEMSKVDDSFPHRLED-SFLV--EEDKR---G SKYPIFATMQ-EEKDYHEKFPTIYHLRKELA                      143
WP_050881965   74 RRRNRILYLQEIFAEEMSKVDDSFPHRLED-SFLV--EEDKR---G SKYPIFATMQ-EEKDYHEKFPTIYHLRKELA                      143
WP_050886065   74 RRRNRILYLQEIFAEEMSKVDDSFPHRLED-SFLV--EEDKR---G SKYPIFATMQ-EEKDYHEKFPTIYHLRKELA                      143
AHN30376       74 RRRNRILYLQEIFAEEMSKVDDSFPHRLED-SFLV--EEDKR---G SKYPIFATMQ-EEKDYHEKFPTIYHLRKELA                      143
EAO78426       74 RRRNRILYLQEIFAEKMSKVDDSFPHRLED-SFLV--EEDKR---G SKYPIFATMQ-EEKDYHEKFPTIYHLRKELA                      143
CCW42055       74 RRRNRILYLQEIFAEEMSKVDDSFPHRLED-SFLV--EEDKR---G SKYPIFATMQ-EEKDYHEKFPTIYHLRKELA                      143
```

```
WP_003041502   74  RRRNRLRYLQEIFAEEMMQVDESFQRLDD-SFLV-DEDKR---G  ERHPIFGNIA-AEVKYHDEFPTIYHLRKHLA  143
WP_037593752   75  RRKNRLRYLQEIFTEEMNKVDENFQRLDD-SFLV-EEDKQ---G  SKYPIFGTLK-EEKEYHKKFKTIYHLREELA  144
WP_049516684   75  RRKNRLRYLQEIFAEEMMQVDESFQRLDD-SFLV-EEDKQ---G  SRYPIFGNIA-AEVKYHDDFPTIYHLRKHLV  144
GAD46167       75  RRKNRLRYLQDIFTEEMNKVDEEMVDDSFQRLDE-SFLT-DNDKN---F  SKYPIFGTLK-EEKEYHKKFKTIYHLREELA  144
WP_018363470   74  RRKNRLRYLQDIFTEEMAKVDDSFQRLDE-SFLV-EEDKK---N  DSHPIFGNKA-EEDAYHQKPPTIYHLRKHLA  143
WP_003043819   74  RRKNRLRYLQEIFANEMAKLDDSFQRLEE-SFLV-EEDKK---N  EHHPIFGNLA-DEVAYHRNYPTIYHLRRHLA  143
WP_062269658   74  RRKNRLRYLQEIFTGEMNKVDENFQRLDD-SFLV-DEDKR---G  EHHPIFGNIA-AEVKYHDDFPTIYHLRRHLA  143
WP_048800889   74  RRKNRLRYLQEIFIEEMNKVDENFQRLDD-SFLV-EEDKR---G  SKYPIFGTLK-EEKEYYKEFETIYHLRRHLA  143
WP_012767106   74  RRKNRIRYLQEIFSSEMSKVDDSFHRLEE-SFLV-TEDKR---G  ERHPIFGNIV-DEVAYHEKYPTIYHLRKKLA  143
WP_014612333   74  RRKNRIRYLQEIFSSEMSKVDDSFHRLEE-SFLV-EEDKK---H  ERHPIFGNIV-DEVAYHEKYPTIYHLRKKLA  143
WP_015017095   74  RRKNRIRYLQEIFSSEMSKVDDSFHRLEE-SFLV-EEDKK---H  ERHPIFGNIV-DEVAYHEKYPTIYHLRKKLA  143
WP_050057649   74  RRKNRIRYLQEIFSSEMSKVDDSFHRLEE-SFLV-EEDKK---H  ERHPIFGNIV-DEVAYHEKYPTIYHLRKKLA  143
WP_048327215   74  RRKNRIRYLQEIFSSEMSKVDDSFHRLEE-SFLV-EEDKK---H  ERHPIFGNIV-DEVAYHEKYPTIYHLRKKLA  143
WP_049519324   74  RRKNRIRYLIKEIFTEEMAKVDDGFQRLED-SFLV-LEDKE---G  NKHPIFANLA-DEVAYHKKYPTIYHLRKELV  143
WP_012515931   74  RRKNRIRYLIKEIFTEEMAKVDDGFQRLED-SFYV-LEDKE---G  NKHPIFANLA-DEVAYHKKYPTIYHLRKELV  143
WP_021320964   74  RRKNRLRFLKEIFTEEMAKVDDGFQRLED-SFLV-LEDKE---G  NKHPIFANLA-DEVAYHKKYPTIYHLRKELV  143
WP_037581760   75  RRKNRLRYLQEIFAKEMAKVDESFQRLEE-SFLT-DDEKT---F  DSHPIFGNKA-EEDTYHQEFPTIYHLRKHLA  144
WP_004232481   75  RRKNRLRYLQEIFAEEMTKVDESFYRLDE-SFLT-TDEKD---F  DSHPIFGNKA-EEDAYHQKPPTIYHLRKHLA  144
WP_099854540   75  RRKNRLRYLQEIFAEEMAKVDESFYRLDE-SFLT-TDDKD---F  ERHPIFGNKA-DEIKYHQEFPTIYHLRKHLA  144
WP_012962174   74  RRKNRLRYLQEIFANEIAKVDEKEKTKVDAKEMTKVDESFQRLDE-SFLT-DDDKT---F  DSHPIFGNKA-EEDAYHQKPPTIYHLRKHLA  143
WP_039995303   74  RRKNRLRYLQEIFAKEMTKVDESFQRLEE-SFLT-DDDKT---F  DSHPIFGNKA-EEDAYHQKPPTIYHLRKHLA  143
WP_014334983   74  RRKYRIKELQKIFSSEMNELDIAFPRLSE-SFLV-SDDKE---F  ENHPIFGNLK-DEITYHNDYPTIYHLRQTLA  143
WP_030992692   74  RRKYRIKELQKIFSSEMNELDIAFPRLSE-SFLV-SDDKE---F  ENHPIFGNLK-DEITYHNDYPTIYHLRQTLA  143
AHY15608       74  RRKYRIKELQKIFSSEMNELDIAFFPRLSE-SFLV-SDDKE---F  ENHPIFGNLK-DEITYHNDYPTIYHLRQTLA  143
AHY17476       74  RRKYRIKELQKIFSSEMNELDIAFFPRLSE-SFLV-SDDKE---F  ENHPIFGNLK-DEITYHNDYPTIYHLRQTLA  143
ESR09100       74  RRKYRIKELQKIFSSEMNELDIAFFPRLSE-SFLV-SDDKE---F  ERHPIFGNLK-DEITYHNDYPTIYHLRQTLA  143
AGM98575       74  RRRNRILYLQEIFSEEMGKVDDSFFHRLED-SFLV-TEDKR---G  ERHPIFGNLE-EEVKYHENFPTIYHLRQYLA  143
ALF27331       74  RRRNRILYLQEIFSEEMGKVDDSFFHRLED-SFLV-TEDKR---G  EEKNYHKNYPTIYHLRKTLA  143
WP_018372492   75  RRKNRIRYLQEIFAEEMNRADENFHRLKE-SFFV-EEDKT---Y  SKYPIFGTLE-EEKEYHKKYPTIYHLRKTLA  144
WP_045618028   74  RRKNRIRYLQEIFAEEMMQHIFAEEMNRADENFISFFHRLDD-SFLI-PEDKR---G  SKYPIFATLT-EEKEYHKQPPTIYHLRKQLA  143
WP_045635197   74  RRKNRILYLQEIFSEEMGKVDDSFFHRLDD-SFLI-PEDKR---E  SKYPIFATLT-EEKEYHKQPPTIYHLRKQLA  143
WP_002263549   74  RRKNRILYLQEIFSEEMSKVDDSFFHRLDD-SFLV-TEDKR---G  ERHPIFGNLE-EEVKYHENFPTIYHLRQYLA  143
WP_002263887   74  RRKNRILYLQEIFSEEMSKVDDSFFHRLED-SFLI-PEDKR---G  ERHPIFGNLE-EEVKYHENFPTIYHLRQYLA  143
WP_002264920   74  RRKNRILYLQEIFSEEMGKVDDSFFHRLED-SFLV-TEDKR---G  DSYPIFGNLE-EEVKYHENFPTIYHLRQYLA  143
WP_002269043   74  RRKNRILYLQEIFSEEMGKVDDSFFHRLED-SFLT-DDDKN---F  ERHPIFGNLE-EEVKYHENFPTIYHLRQYLA  143
WP_002269448   74  RRRNRILYLQEIFSEEMGKVDDSFFHRLED-SFLV-TEDKR---G  ERHPIFGNLE-EEVKYHENFPTIYHLRQYLA  143
WP_002271977   74  RRRNRILYLQEIFSEEMGKVDDSFFHRLED-SFLV-TEDKR---G  ERHPIFGNLE-EEVKYHENFPTIYHLRQYLA  143
WP_002272766   74  RRRNRILYLQEIFSEEMGKVDDSFFHRLED-SFLV-TEDKR---G  ERHPIFGNLE-EEVKYHENFPTIYHLRQYLA  143
WP_002273241   74  RRRNRILYLQEIFSEEMGKVDDSFFHRLED-SFLV-TEDKR---G  SKYPIFGTLE-EEKEYHKKYPTIYHLRKTLA  143
WP_002275430   74  RRRNRILYLQEIFSEEMGKVDDSFFHRLED-SFLV-TEDKR---G  ERHPIFGNLE-EEVKYHENFPTIYHLRQYLA  143
WP_002276448   74  RRRNRILYLQEIFSEEMGKVDDSFFHRLED-FFLV-TEDKR---G  ERHPIFGNLE-EEVKYHENFPTIYHLRQYLA  143
WP_002277050   74  RRRNRILYLQEIFSEEMGKVDDSFFHRLDE-SFLT-DDDKN---F  DSHPIFGNKA-EEDAYHQKPPTIYHLRQYLA  143
WP_002273364   74  RRRNRILYLQEIFAEEMSKVDDSFFHRLED-SFLV-TEDKR---G  ERHPIFGNLE-EEVKYHENFPTIYHLRQYLA  143
WP_002279025   74  RRRNRILYLQEIFSEEMGKVDDSFFHRLED-SFLV-TEDKR---G  ERHPIFGNLE-EEVKYHENFPTIYHLRQYLA  143
WP_002279859   74  RRRNRILYLQEIFSEEMGKVDDSFFHRLED-SFLT-DDDKN---F  DSHPIFGNKA-EEDAYHQKPPTIYHLRQYLA  143
WP_002280230   74  RRRNRILYLQEIFAEEMSKVDDSFFHRLED-SFLV-TEDKR---G  ERHPIFGNLE-EEVKYHENFPTIYHLRQYLA  143
WP_002281696   74  RRRNRILYLQEIFSEEMGKVDDSFFHRLED-SFLV-TEDKR---G  ERHPIFGNLE-EEVKYHENFPTIYHLRQYLA  143
WP_002282247   74  RRRNRILYLQEIFSEEMGKVDDSFFHRLED-SFLV-TEDKR---G  ERHPIFGNLE-EEVKYHENFPTIYHLRQYLA  143
WP_002282906   74  RRRNRILYLQEIFAEEMSKVDDSFFHRLED-SFLT-DDDKN---F  DSHPIFGNKA-EEDAYHQKPPTIYHLRQYLA  143
WP_002283846   74  RRRNRILYLQEIFSEEMGKVDDSFFHRLED-SFLV-TEDKR---G  ERHPIFGNLE-EEVKYHENFPTIYHLRQYLA  143
WP_002287255   74  RRRNRILYLQEIFSEEMGKVDDSFFHRLED-SFLV-TEDKR---G  ERHPIFGNLE-EEVKYHENFPTIYHLRQYLA  143
WP_002288990   74  RRRNRILYLQEIFSEEMGKVDDSFFHRLED-SFLV-TEDKR---G  ERHPIFGNLE-EEVKYHENFPTIYHLRQYLA  143
WP_002289641   74  RRRNRILYLQEIFSEEMGKVDDSFFHRLED-SFLV-TEDKR---G  ERHPIFGNLE-EEVKYHENFPTIYHLRQYLA  143
WP_002290427   74  RRRNRILYLQEIFSEEMGKVDDSFFHRLED-SFLV-TEDKR---G  ERHPIFGNLE-EEVKYHENFPTIYHLRQYLA  143
```

```
                        -continued
WP_002295753    74  RRRNRILYLQEIFSEEMGKVNDSFFHRLED-SFLV--TEDKR---G  ERHPIFGNLE--EEVKYHENPPTIYHLRQYLA  143
WP_002296423    74  RRRNRILYLQEIFSEEMGKVDDSFFHRLED-SFLV--TEDKR---G  ERHPIFGNLE--EEVKYHENPPTIYHLRQYLA  143
WP_002304487    74  RRRNRILYLQEIFAEEMMQVDESFFQRLDD-SFLV--EEDKR---G  SRYPIFGTLK--EEKKYHKEFKTIYHLREKLA  143
WP_002305844    74  RRRNRILYLQEIFSEEMDKVDDSFFHRLED-SFLV--TEDKR---G  ERHPIFGNLE--EEVKYHENPPTIYHLRQYLA  143
WP_002307203    74  RRRNRILYLQEIFSEEMGKVDDSFFHRLED-SFLV--TEDKR---G  ERHPIFGNLE--EEVKYHENPPTIYHLRQYLA  143
WP_002310390    74  RRRNRILYLQEIFSEEMGKVDDSFFHRLED-SFLV--TEDKR---G  ERHPIFGNLE--EEVKYHENPPTIYHLRQYLA  143
WP_002352408    74  RRRNRILYLQEIFSEEMGKVDDSFFHRLED-SFLV--TEDKR---G  ERHPIFGNLE--EEVKYHENPPTIYHLRQYLA  143
WP_012997688    74  RRRNRILYLQEIFAEEMSKVDDSFFHRLED-SFLV--TEDKR---G  ERHPIFGNLE--EEVKYHENPPTIYHLRQYLA  143
WP_014677909    74  RRRNRILYLQEIFSEEMGKVDDSFFHRLED-SFLV--TEDKR---G  ERHPIFGNLE--EEVKYHENPPTIYHLRQYLA  143
WP_019312892    74  RRRNRILYLQEIFAEEMSKVDDSFFHRLED-SFLV--TEDKR---G  ERHPIFGNLE--EEVKYHENPPTIYHLRQYLA  143
WP_019313659    74  RRRNRILYLQEIFSEEMGKVDDSFFHRLED-SFLV--TEDKR---G  ERHPIFGNLE--EEVKYHENPPTIYHLRQYLA  143
WP_019314093    74  RRRNRILYLQEIFSEEMGKVDDSFFHRLED-SFLV--TEDKR---G  ERHPIFGNLE--EEVKYHENPPTIYHLRQYLA  143
WP_019315370    74  RRRNRILYLQEIFSEEMGKVDDSFFHRLED-SFLV--TEDKR---G  ECHPIFGNLE--EEVKYHENPPTIYHLRQYLA  143
WP_019803776    74  RRRNRILYLQEIFSEEMGKVDDSFFHRLED-SFLV--TEDKR---G  ERHPIFGNLE--EEVKYHENPPTIYHLRQYLA  143
WP_019805234    74  RRRNRILYLQEIFSEEMGKVDDSFFHRLED-SFLV--TEDKR---G  ERHPIFGNLE--EEVKYHKEFPTIYHLRQYLA  143
WP_024783594    74  RRRNRILYLQEIFSEEMGKVDDSFFHRLED-SFLV--TEDKR---G  ERHPIFGNLE--EEVKYHENPPTIYHLRQYLA  143
WP_024784288    74  RRRNRILYLQEIFAEEMSKVDDSFFHRLDE-SFLT--DDDKN---F  DSHPIFGNKA--EEDAYHQKPPTIYHLRKHLA  143
WP_024784666    74  RRRNRILYLQEIFAEEMSKVDDSFFHRLED-SFLV--TEDKR---G  ERHPIFGNLE--EEVKYHENPPTIYHLRQYLA  143
WP_024784894    74  RRRNRILYLQEIFSEEMGKVDDSFFHRLED-SFLV--TEDKR---G  ERHPIFGNKA--EEDAYHQKPFTIYHLRKHLA  143
WP_024786433    74  RRRNRILYLQEIFAEEMNKVDDSFFHRLDE-SFLT--DDDKN---F  DSHPIFGNKA--EEDAYHQKPPTIYHLRKHLA  143
WP_049473442    74  RRRNRILYLQEIFSEEMGKVDDSFFHRLED-SFLV--TEDKR---G  ERHPIFGNLE--EEVKYENPPTIYHLRQYLA  143
WP_049474547    74  RRRNRILYLQEIFSEEMGKVDDSFFHRLED-SFLV--TEDKR---G  ERHPIFGNLE--EEVKYHENPPTIYHLRQYLA  143
EMC03581        67  RRKNRLRYLQEIFAEEMSKVDSSFFHRLED-SFLI--PEDKK---G  SKYPIFATLI--EEKEYHKQFPTIYHLRKQLA  136
WP_000428612    75  RRKNRLRYLQEIFAEEMSKVDSSFFHRLED-SFLI--PEDKK---G  SKYPIFATLE--EEKEYHKKFPTIYHLRKHLA  144
WP_000428613    74  RRRNRLRYLQEIFAEEMSKVDSSFFHRLDD-SFLV--PEDKR---G  SKYPIFATLA--EEKEYHKQFPTIYHLRKQLA  143
WP_049522028    75  RRRNRILYLQEIFAAEMMKVDESFFHRLDD-SFLV--PEDKR---G  SKYPIFGTLE--EEKEYHKQFPTIYHLRKILA  144
WP_003107102    43  RRINRIKYLQSIFDDEMSKIDSAFFQRIKD-SFLH--PDDKN---D  DRHPIFGNIK--DEVDYHKNYPTIYHLRKKLA  112
WP_054279288    76  RRKNRLCYLRDIFSEMHTIDKHFFLRLED-SFLH--KSDKR---Y  EAHPIFGTLQ--EEKAYHDNYPTIYHLRKALA  145
WP_049531101    75  RRKNRLRYLQEIFSEEISKVDNSFFHRLDD-SFLV--PEDKR---G  SKYPIFATLT--EEKEYYKQFPTIYHLRKALA  144
WP_049538452    75  RRKNRLRYLQEIFAEEMNKVDSSFFHRLDD-SFLV--PEDKR---G  SKYPIFATLA--EEKEYHKNPTIYHLRKQLA  144
WP_049549711    75  RRKNRLRYLQEIFGEMSKVDSSFFHRLDD-SFLV--PEDKR---G  SKYPIFGTLV--EEKEYHKQFPTIYHLRKQLA  144
WP_007896501    76  RRRYRLCQLONIFATEMVKVDDTFFQRLSE-SFFY--YQDKA---F  DKHPIFGNSK--EERAYHKTYPTIYHLRKDLA  145
EFR44625        28  RRRYRLCQLONIFATEMVKVDDTFFQRLSE-SFFY--YQDKA---F  DKHPIFGNSK--EERAYHKTYPTIYHLRKDLA  97
WP_002897477    74  RRRNRILYLQEIFTTSMNEIDESFFHRLDD-SFLV--PEDKR---G  SKYPIFATLQ--EEKEYHKQFPTIYHLRKDLA  143
WP_002906454    75  RRKNRLRYLQEIFSEEISKLDSSFFHRLDD-SFLV--PEDKR---G  SKYPIFATLE--EEKKYHKKFPTIYHLRKHLA  144
WP_009729476    75  RRKNRLRYLQEIFSEEIGKVDSSFFHRLDD-SFLI--PEDKR---G  SKYPIFATLA--EEVKYHEKFPTIYHLRKQLA  144
CQR24647        75  RRKNRLRYLQDIFSPELNQVDESFLHRLDD-SFLVa--EDKR---G  ERHVIFGNIA--DEVKYHKEFPTIYHLRKHLA  144
WP_000666813    75  RRKNRLRYLQEIFSQEISKVDSSFFHRLDD-FFLV--PEDKR---G  SKYPIFATLV--EEKEYHKKFPTIYHLRKHLA  144
WP_009754323    75  RRKNRLRYLQEIFAEEMSKVDSSFFHRLDD-SFLV--PEDKS---G  SKYPIFATLA--EEKEYHKQFPTIYHLRKHLA  144
WP_044674937    74  RRKNRLRYLQEIFAEEINKVDSSFFQRLDD-SFLV--EDKQ---G  SKHPIFGTLQ--EEKKYHKQFPTIYHLRKQLA  143
WP_044676715    75  RRKNRLRYLQEIFAEEINKIDDSFFQRLDD-SFLV--EDKQ---G  SKHPIFGTLQ--EEKEYHKQFPTIYHLRKQLA  144
WP_044680361    74  RRKNRLRYLQEIFAEEINKIDDSFFQRLDD-SFLI--EDKQ---G  SKHPIFGTLQ--EEKEYHKQFPTIYHLRKQLA  143
WP_044681799    74  RRKNRLRYLQEIFAEEINKIDDSFFQRLDD-SFLI--EDKQ---G  SKHPIFGTLQ--EEKKYHKQFPTIYHLRKQLA  143
WP_049533112    74  RRRNRLRYLQEIFAEEMNKVDENFQRLDD-SFLV--DEDKR---G  ERHPIFGNIA--AEVKYHDDFPTIYHLRKHLA  143
WP_029090905    28  HRKPFRLLLEDMFKEEILSKDPSFFIRLKE-AFLSpkDEQKQ---F  ---LFNDKDyTDADYYEQYKTIYHLRYDLI   100
WP_006506696    61  KRRERIRLLRAIILQDMVLEKDPTFFIRLEHtSFLD-EEDKAKylG  DNYNLFIDEDfNDYTYYHKYPTIYHLRKAIC   139
AIT42264        74  RRKNRICYLQEIFSNEMAKVDDSFFHRLEE-SFLV--EEDKK---H  ERHPIFGNIV--DEVAYHEKFPTIYHLRKKLV   143
WP_034440723    73  RRKNRICYLQEIFSNEMAKVDDSFFHRLDE-SFLV--EEDKK---Y  SKYPIFSNEK--EDKNYDKYPTIYHLRKKLV   142
AKQ21048        74  RRRFRIRELQKIFDKSMGEVDSNFFHRLDE-SFLV--EEDKE---H  DRHPIFGNLE--EEVAYHEKYPTIYHLRKKLV   143
WP_004636532    74  RRRNRLRYLQDIFQQPMLAIDENFFHRLDD-SFFV--PDDKS---Y  DRHPIFGSLE--EEVAYHNTYPTIYHLRKKLA   143
WP_002364836    74  RRRNRLRYLQAFFEEAMTDLDENFFARLQE-SFLV--PEDKK---W  HRHPIFAKLE--DEVAYHETYPTIYHLRKKLA   143
WP_016631044    25  RRRNRLRYLQAFFEEAMTDLDENFFARLQE-SFLV--PEDKK---W  HRHPIFAKLE--DEVAYHETYPTIYHLRKKLA   94
EMS75795                                                                                            
WP_002373311    74  RRRNRLRYLQAFFEEAMTDLDENFFARLQE-SFLV--PEDKK---W  HRHPIFAKLE--DEVAYHETYPTIYHLRKKLA   143
```

```
                                                   -continued
WP_002378009   74  RRRNRLRYLQAFFEEAMTALDENFFARLQE-SFLV--PEDKK----W  HRHPIFAKLE-DEVAYHETYPTIYHLRKKLA  143
WP_002407324   74  RRRNRLRYLQAFFEEAMTALDENFFARLQE-SFLV--PEDKK----W  HRHPIFAKLE-DEVAYHETYPTIYHLRKKLA  143
WP_002413717   74  RRRNRLRYLQAFFEEAMTDLDENFFARLQE-SFLV--PEDKK----W  HRHPIFAKLE-DEVAYHETYPTIYHLRKKLA  143
WP_010775580   74  RRRNRLRYLQAFFEEAMTALDENFFARLQE-SFLV--PEDKK----W  HRHPIFAKLE-DEVAYHETYPTIYHLRKKLA  143
WP_010818269   74  RRRNRLRYLQAFFEEAMTALDENFFARLQE-SFLV--PEDKK----W  HRHPIFAKLE-DEVAYHETYPTIYHLRKKLA  143
WP_010824395   74  RRRNRLRYLQAFFEEAMTALDENFFARLQE-SFLV--PEDKK----W  HRHPIFAKLE-DEVAYHETYPTIYHLRKKLA  143
WP_016622645   74  RRRNRLRYLQAFFEEAMTALDENFFARLQE-SFLV--PEDKK----W  HRHPIFAKLE-DEVAYHETYPTIYHLRKKLA  143
WP_033624816   74  RRRNRLRYLQAFFEEAMTALDENFFARLQE-SFLV--PEDKK----W  HRHPIFAKLE-DEVAYHETYPTIYHLRKKLA  143
WP_033625576   74  RRRNRLRYLQAFFEEAMTALDENFFARLQE-SFLV--PEDKK----W  HRHPIFAKLE-DEVAYHETYPTIYHLRKKLA  143
WP_033789179   74  RRRNRLRYLQAFFEEAMTALDENFFARLQE-SFLV--PEDKK----W  HRHPIFAKLE-DEVAYHETYPTIYHLRKKLA  143
WP_002310644   74  RRRQRILELQKIFAPEILKIDEHFFARLNE-SFLV--PEDKK----Q  SRHPVFATIK-QEKSYHQTYPTIYHLRQALA  143
WP_002312694   74  RRRQRILELQKIFAPEILKIDEHFFARLNE-SFLV--PEDKK----Q  SRHPVFATIK-QEKSYHQTYPTIYHLRQALA  143
WP_002314015   74  RRRQRILELQKIFAPEILKIDEHFFARLNE-SFLV--LDEKK----Q  SRHPVFATIK-QEKSYHQTYPTIYHLRQALA  143
WP_002320716   74  RRRQRILELQKIFAPEILKIDEHFFARLNE-SFLV--LDEKK----Q  SRHPVFATIK-QEKSYHQTYPTIYHLRQALA  143
WP_002330729   74  RRRQRILELQKIFAPEILKIDEHFFARLNE-SFLV--LDEKK----Q  SRHPVFATIK-QEKSYHQTYPTIYHLRQALA  143
WP_002335161   74  RRRQRILELQKIFAPEILKIDEHFFARLNE-SFLV--LDEKK----Q  SRHPVFATIK-QEKSYHQTYPTIYHLRQALA  143
WP_002345439   74  RRRQRILELQKIFAPEILKIDEHFFARLNE-SFLV--LDEKK----Q  SRHPVFATIK-QEKSYHQTYPTIYHLRQALA  143
WP_034867970   74  RRKYRLSKLQDLFABELCKQDDCFVRLEE-SFLV--PEEKQ----Y  KPASIFPTLE-EEKEYYQKYPTIYHLRQKLV  143
WP_047937432   74  RRKYRLSKLQDLFABELCKQDDCFVRLEE-SFLV--LDEKK----Q  KPASIFPTLE-EEKEYYQKYPTIYHLRQKLV  143
WP_010720994   74  RRKYRLSKLQDLFABELCKQDDCFVRLEE-SFLV--PEDKK----Y  KPASIFPTLE-EEKEYYQKYPTIYHLRQKLV  143
WP_010737004   74  RRKYRLSKLQDLFABELCKQDDCFVRLEE-SFLV--PEEKQ----Y  KPASIFPTLE-EEKEYYQKYPTIYHLRQKLV  143
WP_034700478   74  RRKYRLSKLQDLFABELCKQDDCFVRLEE-SFLV--PEEKQ----Y  DKHPIFGTLD-EEIHFHEQFPTIYHLRKKYLA  143
WP_007209003   74  RRKNRICYLQEIFQPEMNHLDNNFYRLNE-SFLVa--DDAK---Y  AKFPVFATLS-EEKNYHRQYPTIYHLRHDLA  143
WP_023519017   74  RRRQRVLALQDIFAEEIHKDPNFFARLEE-GDRV--EADKR----F  ERHAIFGKME-EEVSYYREFPTIYHLRKHLA  143
WP_010777040   74  RRRNRICRLQDLFTEEMNQVDANFHRLQE-SFLV--PDEKE----F  ERHRIFGTIE-EEVAYHKNVATIYHLRKHLA  143
WP_048604708   74  RRRQRISYLQTFFQEEMNRIDPNFFNRLDE-SFLI--EEDKL----S  ERHPIFGTIE-EEKAYYQNYPTIYHLRQKLA  143
WP_010750235   74  RRKYRILELQKIFSEEILKKDSHFFARLDE-SFLI--PEDKQ----Y  ARFPIFPTLL-EEKAYYQNYPTIYHLRQKLA  182
AII16583      113  RRKNRICYLQEIFSNEMAKVDDSFPHRLEE-SFLV--EEDKK----H  ERHPIFGNIV-EEVAYHEKYPTIYHLRKKLV  144
WP_029073316   66  KRRERIRLLRGIMEDMVLDVDPTFFIRLANvSFLD--QEDKKdy1K  SNYNLFIDKDfNDKTYDKYPTIYHLRKHLC  144
WP_031589969   66  KRRERIRLLREIMEDMVLDVDPTFFIRLANvSFLD--QEDKKdy1K  SNYNLFIDKDfNDKTYDKYPTIYHLRSELA  144
KDA45870       75  RRKWRLGLLREIFEPYITPVDDTFFLRKKQ-SSLVa--EDKK----Y  DVYPIFGKRE-EELLYHDTHKTIYHLRYKLM  132
WP_039099354   62  RRKNRINWLNEIFSSELANTDPSFLIRLQN-SWVSkkDPDRK----R  -QTSLFNDRT--DRAFYDDYPTIYHLRYKLM  137
AKP02966       65  RRKWRLGLLREIFEPYITPVDDTFFLRKKQ-SNLS--PKDQR----K  DKYNLFIDNPyTDKEYYREFPTIFHLRKELI  143
WP_010991369   74  RRRNRISYLQGIFAREMSKTDANFFCRLSD-SFYV--DNEKR----N  SRHPFFATIE-EEVEYHKNYPTIYHLREELV  143
WP_033838504   77  RRRNRISYLQGIFAREMSKTDANFFCRLSD-SFYV--DNEKR----N  SRHPFFATIE-EEVEYHKNYPTIYHLREELV  143
EHN60060       77  RRRNRISYLQGIFAREMSKTDANFFCRLSD-SFYV--DNEKR----N  SRHPFFATIE-EEVEYHKNYPTIYHLREELV  146
EFR89594          ---------------------------------------------    -------------------------------
EFR95520       74  RRRNRIAYLQEIFAAEMAEVDANFYRLED-SFYI--ESEKR----H  SRHPFFATIE-EEVAYHEEYKTIYHLREKLV  143
WP_038409211   74  RRRNRISYLQEIFAVEMANIDANFFCRLND-SFYV--DSEKR----N  SRHPFFATIE-EEVAYHDNYRTIYHLREELV  143
WP_003723650   74  RRRNRISYLQEIFAVEMANIDANFFCRLND-SFYV--DSEKR----N  SRHPFFATIE-EEVAYHKNYRTIYHLREELV  143
WP_003727705   74  RRRNRISYLQEIFAVEMANIDANFFCRLND-SFYV--DSEKR----N  SRHPFFATIE-EEVAYHKNYRTIYHLREELV  143
WP_003730785   74  RRRNRISYLQEIFAVEMANIDANFFCRLND-SFYV--ESDKK----Y  SRHPFFGTVE-EEVAYYKDFPTIYHLRKELI  143
WP_003733029   74  RRRNRISYLQEIFAIQMNEVDDNFFCRLKE-SFYA--ESDKK----Y  NRHPFFGTVE-EEVAYYKDFPTIYHLRKELI  143
WP_003739838   74  RRRNRISYLQEIFALEMANIDANFFCRLND-SFYV--DSEKR----N  SRHPFFATIE-EEVAYHKNYRTIYHLREELV  143
WP_014601172   74  RRRNRISYLQEIFAVEMANIDANFFCRLND-SFYV--DSEKR----N  SRHPFFATIE-EEVAYHKNYRTIYHLREELV  143
WP_023548323   74  RRRNRISYLQEIFAVEMANIDANFFCRLND-SFYV--DSEKR----N  SRHPFFATIE-EEVAYHKNYRTIYHLREELV  143
WP_031665337   74  RRRNRISYLQEIFAVEMANIDANFFCRLND-SFYV--DSEKR----N  SRHPFFATIE-EEVAYHKNYRTIYHLREELV  143
WP_031669209   74  RRRNRISYLQEIFAIQMNEVDDNFFCRLND-SFYV--ESDKK----Y  NRHPFFGTVE-EEVAYHKNYRTIYHLREELV  143
WP_033920898   77  RRRNRISYLQEIFAVEMANIDANFFCRLND-SFYV--DSEKR----N  SRHPFFATIE-EEVAYHKNYRTIYHLREELV  146
AKI42028       77  RRRNRISYLQEIFAVEMANIDANFFCRLND-SFYV--DSEKR----N  SRHPFFATIE-EEVAYHKNYRTIYHLREELV  146
AKI50529          ---------------------------------------------    -------------------------------
EFR83390          ---------------------------------------------    -------------------------------
WP_046323366   74  RRRNRISYLQEIFTAEMFEVDANFYRLED-SFYI--ESEKR----Q  SRHPFFATIE-EEVAYHENVRTIYHLREKLV  143
AKE81011       90  RRKNRICYLQEIFSNEMAKVDDSFPHRLEE-SFLV--EEDKK----H  ERHPIFGNIV-DEVAYHEKYPTIYHLRKKLV  159
```

```
                                                            -continued

CUO82355            65  KRRERIRLRAILQDMVLEKDPTFFIRLEHtSFLD--EEDKAkylG    DNYNLFIDEDfNDTYYHKPTIYHLRKALC    143
WP_033162887        66  KRRERIRLRLLRDLLGDMVEVDPTFFIRLLNvSFLD--EEDKQknlG   DNYNLFIEKDfNDKTYYDKPTIYHLRKELC    144
AGZ01981           107  RRKNRICYLQEIFSNEMAKVDDSFPHRLEE-SFLV--EEDKK---H    ERHPIFGNIV-DEVAYHEKPTIYHLRKKLV    176
AKA60242            74  RRKNRICYLQEIFSNEMAKVDDSFPHRLEE-SFLV--EEDKK---H    ERHPIFGNIV-DEVAYHEKPTIYHLRKKLV    143
AKS40380            74  RRKNRICYLQEIFSNEMAKVDDSFPHRLEE-SFLV--EEDKK---H    ERHPIFGNIV-DEVAYHEKPTIYHLRKKLV    143
4UN5_B              78  RRKNRICYLQEIFSNEMAKVDDSFPHRLEE-SFLV--EEDKK---H    ERHPIFGNIV-DEVAYHEKPTIYHLRKKLV    147

WP_010922251       144  DSTDKADLRLIYLALAHMIKFRGHFLIEGD-LNPDNSDVQKL--FIQLVQTYNQL--FEEN--    INASGVDAK---AI    211

WP_039695303       145  DSSEKADLRLVYLALAHMIKFRGHFLIEGE-LNAENTDVQKI--FADFVGVYNRT--FDDS-H   LSEITVDVA---SI    212
WP_045635197       144  DSKEKTDLRLIYLALAHMIKYRGHFLYEEA-FDIKNNDIQKI--FNEFISIYDNT--FEGS-S   LSQONAQVE---AI    211
5AXW_A             105  EEEFSA------ALLHLAKRRG---VHNV------NEVE-------EDT---GN--          ----------E-    134
WP_009880683         -  ---------------------------------------------------------        -----------     -
WP_010922251       144  DSTDKADLRLIYLALAHMIKFRGHFLIEGD-LNPDNSDVDKL--FIQLVQTYNQL--FEEN--   INASGVDAK---AI    211
WP_011054416       144  DSTDKVDLRLIYLALAHMIKFRGHFLIEGD-LNPDNSDVDKL--FIQLVQTYNQL--FEEN--   INASRVDAK---AI    211
WP_011284745       144  DSTDKADLRLIYLALAHMIKFRGHFLIEGD-LNPDNSDVDKL--FIQLVQTYNQL--FEEN--   INASGVDAK---AI    211
WP_011285506       144  DSTDKADLRLIYLALAHMIKFRGHFLIEGD-LNPDNSDVDKL--FIQLVQTYNQL--FEEN--   INASGVDAK---AI    211
WP_011527619       144  DSTDKADLRLIYLALAHMIKFRGHFLIEGD-LNPDNSDVDKL--FIQLVQTYNQL--FEEN--   INASGVDAK---AI    211
WP_012560673       144  DSTDKADLRLIYLALAHMIKFRGHFLIEGD-LNPDNSDVDKL--FIQLVQTYNQL--FEEN--   INASRVDAK---AI    211
WP_014407541       144  DSTDKADLRLIYLALAHMIKFRGHFLIEGD-LNPDNSDVDKL--FIQLVQIYNQL--FEEN--   INASGVDAK---AI    211
WP_020905136       144  DSTDKADLRLIYLALAHMIKFRGHFLIEGD-LNPDNSDVDKL--FIQLVQTYNQL--FEEN--   INASGVDAK---AI    211
WP_023080005       144  DSTDKADLRLIYLALAHMIKFRGHFLIEGD-LNPDNSDVDKL--FIQLVQTYNQL--FEEN--   INASRVDAK---AI    211
WP_023610282       144  DSTDKVDLRLIYLALAHMIKFRGHFLIEGD-LNPDNSDVDKL--FIQLVQTYNQL--FEEN--   INASRVDAK---AI    211
WP_030125963       144  DSTDKADLRLIYLALAHMIKFRGHFLIEGD-LNPDNSDVDKL--FIQLVQTYNQL--FEEN--   INASRVDAK---AI    211
WP_030126706       144  DSTDKADLRLIYLALAHMIKFRGHFLIEGD-LNPDNSDVDKL--FIQLVQTYNQL--FEEN--   INASRVDAK---AI    211
WP_031488318       144  DSTDKADLRLIYLALAHMIKFRGHFLIEGD-LNPDNSDVDKL--FIQLVQTYNQL--FEEN--   INASRVDAK---AI    211
WP_032460140       144  DSTDKADLRLIYLALAHMIKFRGHFLIEGD-LNPDNSDVDKL--FIQLVQTYNQL--FEEN--   INASGVDAK---AI    211
WP_032461947       144  DSTDKADLRLIYLALAHMIKFRGHFLIEGD-LNPDNSDVDKL--FIQLVQTYNQL--FEEN--   INASGVDAK---AI    211
WP_032462016       144  DSTDKADLRLIYLALAHMIKFRGHFLIEGG-LNPDNSDVDKL--FIQLVQTYNQL--FEEN--   INANGVDAK---AI    211
WP_032462936       144  DSTDKADLRLIYLALAHMIKFRGHFLIEGD-LNPDNSDVDKL--FIQLVQTYNQL--FEEN--   INASGVDAK---AI    211
WP_032464890       144  DSTDKADLRLIYLALAHMIKFRGHFLIEGD-LNPDNSDVDKL--FIQLVQTYNQL--FEEN--   INASGVDAK---AI    211
WP_033888930         1  -----------------------------------PDNSDVDKL--FIQLVQTYNQL--FEEN-- INASGVDAK---AI     36
WP_038431314       144  DSTDKADLRLIYLALAHMIKFRGHFLIEGD-LNPDNSDVDKL--FIQLVQTYNQL--FEEN--   INASRVDAK---AI    211
WP_038432938       144  DSTDKVDLRLIYLALAHMIKFRGHFLIEGD-LNPDNSDVDKL--FIQLVQTYNQL--FEEN--   INASRVDAK---AI    211
WP_038434062       144  DSTDKADLRLIYLALAHMIKFRGHFLIEGD-LNPDNSDVDKL--FIQLVQTYNQL--FEEN--   INASRVDAK---AI    211
BAQ51233            55  DSTDKADLRLIYLALAHMIKFRGHFLIEGD-LNPDNSDVDKL--FIQLVQTYNQL--FEEN--   INASGVDAK---AI    122
KGE60162             -  ---------------------------------------------------------        -----------     -
KGE60856             -  ---------------------------------------------------------        -----------     -

WP_002989955       144  DSTDKADLRLIYLALAHMIKFRGHFLIEGD-LNPDNSDVDKL--FIQLVQTYNQL--FEEN--   INASGVDAK---AI    211
WP_003030002       144  DISQKADLRLVYLALAHIIKFRGHFLIEGQ-LKAENTNVQAL--FKDFVEVYDKT--VEES-H   LSEMTVDAL---SI    211
WP_003065552       147  DSSEKADLRLVYLALAHIIKFRGHFLIEGE-LNAENTDVQKI--FADFVGVYDRT--FDDS-H   LSEITVDAA---SI    214
WP_001040076       144  DKKEKADLRLIYIALAHIIKFRGHFLIEDDrFDVRNTDIQKQ--YQAFLEIFDTT--FENN-D   LLSQDDVDE---AI    212
WP_001040078       144  DKQEKADLRLIYIALAHIIKFRGHFLIEDSFDVRNTDISKQ--YQDFLEIFNIT--FENN-D    LLSQNVDVE---AI    212
WP_001040080       144  DKKEKADLRLIYIALAHIIKFRGHFLIEDDSFDVRNTDISKQ--YQDFLEIFNIT--FENN-D   LLSQNVDVE---AI    212
WP_001040081       144  DKKEKADLRLIYIALAHIIKFRGHFLIEDDSFDVRNTDISKQ--YQDFLEIFNTT--FENN-D   LLSQNVDVE---AI    212
WP_001040083       144  DKKEKADLRLIYIALAHIIKFRGHFLIEDDSFDVRNTDISKQ--YQDFLEIFNTT--FENN-D   LLSQNVDVE---AI    212
WP_001040085       144  DKKEKADLRLIYIALAHIIKFRGHFLIEDDSFDVRNTDISKQ--YQDFLEIFNTT--FENN-D   LLSQNVDVE---AI    212
WP_001040087       144  DKKEKADLRLIYIALAHIIKFRGHFLIEDDSFDVRNTDISKQ--YQDFLEIFNTT--FENN-D   LLSQNVDVE---AI    212
WP_001040088       144  DKKEKADLRLIYIALAHIIKFRGHFLIEDDSFDVRNTDISKQ--YQDFLEIFNTT--FENN-D   LLSQNVDVE---AI    212
WP_001040089       144  DKKEKADLRLIYIALAHIIKFRGHFLIEDDSFDVRNTDISKQ--YQDFLEIFNTT--FENN-D   LLSQNVDVE---AI    212
WP_001040090       144  DKKEKADLRLIYIALAHIIKFRGHFLIEDDSFDVRNTDISKQ--YQDFLEIFNTT--FENN-D   LLSQNVDVE---AI    212
WP_001040091       144  DKKEKADLRLIYIALAHIIKFRGHFLIEDDSFDVRNTDISKQ--YQDFLEIFNTT--FENN-D   LLSQNVDVE---AI    212
WP_001040092       144  DKKEKADLRLVYLALAHIIKFRGHFLIEDDrFDVRNTDIQKQ--YQAFLEIFDTS--FENN-H   LLSQNVDVE---AI    212
WP_001040094       144  DKKEKADLRLIYIALAHIIKFRGHFLIEDDrFDVRNTDIQKQ--YQAFLEIFDTT--FENN-D   LLSQNVDVE---AI    212
```

```
                                                              -continued
WP_001040095    144   DKKEKADLRLIYLALAHIIKFRGHFLIEDDrFDVRNTDIQKQ--YQAFLEIFDTT--FENN-D   LLSQNVDVE---AI   212
WP_001040096    144   DKKEKADLRLIYLALAHIIKFRGHFLIEDDrFDVRNTDIQKQ--YQAFLEIFDTT--FENN-D   LLSQNVDVE---AI   212
WP_001040097    144   DKKEKADLRLIYLALAHIIKFRGHFLIEDDrFDVRNTDIQKQ--YQAFLEIFDTT--FENN-D   LLSQNVDVE---AI   212
WP_001040098    144   DKKEKADLRLIYLALAHIIKFRGHFLIEDDrFDVRNTDIQKQ--YQAFLEIFDTT--FENN-D   LLSQNVDVE---AI   212
WP_001040099    144   DKKEKADLRLIYLALAHIIKFRGHFLIEDDrFDVRNTDIQKQ--YQAFLEIFDTT--FENN-D   LLSQNVDVE---AI   212
WP_001040100    144   DKKEKADLRLIYLALAHIIKFRGHFLIEDDrFDVRNTDIQKQ--YQAFLEIFDTT--FENN-D   LLSQNVDVE---AI   212
WP_001040104    144   DKKEKADLRLIYLALAHIIKFRGHFLIEDDsFDVRNTDISKQ--YQDFLEIFNTT--FENN-D   LLSQNVDVE---AI   212
WP_001040105    144   DKKEKADLRLIYLALAHIIKFRGHFLIEDDsFDVRNTDISKQ--YQDFLEIFNTT--FENN-D   LLSQNVDVE---AI   212
WP_001040106    144   DKKEKANLRLVYLALAHIIKFRGHFLIEDDsFDVRNTDIQRQ--YQAFLEIFDTT--FENN-H   LLSQNIDVE---GI   212
WP_001040107    144   DKKEKADLRLVYLALAHIIKFRGHFLIEDDsFDVRNTDIQRQ--YQAFLEIFDTT--FENN-H   LLSQNIDVE---GI   212
WP_001040108    144   DKKEKANLRLIYLALAHIIKFRGHFLIEDDsFDVRNTDIQRQ--YQAFLEIFDTT--FENN-H   LLSQNIDVE---GI   212
WP_001040109    144   DKKEKANLRLVYLALAHIIKFRGHFLIEDDsFDVRNTDIQRQ--YQAFLEIFDTT--FENN-H   LLSQNIDVE---GI   212
WP_001040110    144   DKKEKANLRLIYLALAHIIKFRGHFLIEDDsFDVRNTDIQRQ--YQAFLEIFDTT--FENN-H   LLSQNIDVE---GI   212
WP_015058523    144   DKKEKADLRLIYLALAHIIKFRGHFLIEDDrFDVRNTDIQRQ--YQAFLEIFDTS--FENN-H   LLSQNVDVE---AI   212
WP_017643650    144   DKKEKADLRLIYLALAHIIKFRGHFLIEDDsFDVRNTDISKQ--YQDFLEIFDTT--FENN-D   LLSQNIDIE---GI   212
WP_017647151    144   DKKEKADLRLFYLALAHIIKFRGHFLIEDDsFDVRNTDIQRQ--YQAFLEIFDTT--FENN-H   LLSQNIDIE---GI   212
WP_017648376    144   DKKEKADLRLIYLALAHIIKFRGHFLIEDDsFDVRNTDIQRQ--YQAFLEIFDTT--FENN-H   LLSQNVDVE---AI   212
WP_017649527    144   DKKEKADLRLIYIALAHIIKFRGHFLIEDDsFDVRNTDISKQ--YQDFLEIFNTT--FENN-D   LLSQNVDVE---AI   212
WP_017771611    144   DKKEKANLRLIYIALAHIIKFRGHFLIEDDsFDVRNTDISKQ--YQDFLEIFDTT--FENN-H   LLSQNIDVE---GI   212
WP_017771984    144   DKKEKADLRLIYIALAHIIKFRGHFLIEDDsFDVRNTDISKQ--YQDFLEIFNTT--FENN-D   LLSQNVDVE---AI   212
CFQ25032        144   DKKEKADLRLIYIALAHIIKFRGHFLIEDDsFDVRNTDIQRQ--YQDFLEIFNTT--FENN-D   LLSQNVDVE---AI   212
CFV16040        144   DKKEKADLRLIYIALAHIIKFRGHFLIEDDsFDVRNTDIQRQ--YQDFLEIFNTT--FENN-D   LLSQNVDVE---AI   212
KLJ37842        144   DKKEKADLRLIYIALAHIIKFRGHFLIEDDsFDVRNTDISKQ--YQDFLEIFNTT--FENN-D   LLSQNVDVE---AI   212
KLJ72361        144   DKKEKADLRLIYIALAHIIKFRGHFLIEDDsFDVRNTDISKQ--YQDFLEIFDTT--FENN-D   LLSQNIDVE---GI   212
KLL20707        144   DKKEKADLRLIYIALAHIIKFRGHFLIEDDsFDVRNTDIQRQ--YQDFLEIFNTT--FENN-D   LLSQNIDVE---GI   212
KLL42645        144   DKKEKADLRLIYIALAHIIKFRGHFLIEDDsFDVRNTDIQRQ--YQAFLEIFDTT--FENN-D   LLSQNVDVE---AI   212
WP_047207273    144   DKKEKADLRLIYIALAHIIKFRGHFLIEDDsFDVRNTDISKQ--YQDFLEIFDTT--FENN-D   LLSQNVDVE---AI   212
WP_047209694    144   DKKEKADLRLIYIALAHIIKFRGHFLIEDDsFDVRNTDISKQ--YQDFLEIFDTT--FENN-D   LLSQNVDVE---AI   212
WP_050198062    144   DKKEKADLRLIYIALAHIIKFRGHFLIEDDsFDVRNTDISKQ--YQDFLEIFNTT--FENN-D   LLSQNVDVE---AI   212
WP_050201642    144   DKKEKADLRLIYIALAHIIKFRGHFLIEDDsFDVRNTDIQRQ--YQAFLEIFDTT--FENN-D   LLSQNIDVE---GI   212
WP_050204027    144   DKKEKANLRLIYIALAHIIKFRGHFLIEDDsFDVRNTDISKQ--YQAFLEIFDTT--FENN-H   LLSQNIDVE---GI   212
WP_050881965    144   DKKEKANLRLIYIALAHIIKFRGHFLIEDDsFDVRNTDISKQ--YQDFLEIFNTT--FENN-D   LLSQNVDVE---AI   212
WP_050886065    144   DKKEKADLRLIYIALAHIIKFRGHFLIEDDsFDVRNTDISKQ--YQDFLEIFNTT--FENN-D   LLSQNVDVE---AI   212
AHN30376        144   DKKEKADLRLIYIALAHIIKFRGHFLIEDDsFDVRNTDIQKQ--YQAFLEIFDTS--FENN-H   LLSQNVDVE---GI   212
EA078426        144   DKKEKADLRLIYIALAHIIKFRGHFLIEDDsFDVRNTDISKQ--YQDFLEIFNTT--FEES-H   LLSQNVDVE---AI   212
CCW42055        144   DKKEKADLRLIYIALAHIIKFRGHFLIEDDsFDVRNTDIQKQ--YQAFLEIFDTT--FENN-H   LLSQNVDVE---AI   212
WP_003041502    144   DISQKADLRLIYLALAHMIKFRGHFLIEGD-LKAENTNVQAL--FKDFVEVYDKT--VEES-H   LSEITVDAL---SI   211
WP_037593752    144   DISQKADLRLIYLALAHMIKFRGHFLIEGQ-LKAENTDVQAL--FKDFVEVYDKT--IEES-H   LSEITVDAL---SI   211
WP_049516684    145   NSKEKADLRLIYLALAHMIKFRGHFLYEGD-LKAENTNVQAL--FKDFVEVYDKT--VEES-H   LSEMTVDAL---SI   212
GAD46167        145   NSKEKADLRLIYLALAHMIKFRGHFLYEGD-LKAENTDVQAL--FKDFVEEYDKT--IEES-H   LSEITVDAL---SI   212
WP_018363470    145   DSTEKADLRLIVYLALAHMIKFRGHFLIEGK-LNAENSDVAKL--FYQLIQTYNQL--FEES-    LDEIEVDAK---GI   212
WP_003043819    144   DSPEKADLRLIYIALAHMIKFRGHFLIEGK-LNAENSDVAKL--FYQLIQTYNQL--FEES-    LDEIEVDAK---GI   212
WP_006269658    144   DTSKKADLRLIYLALAHMIKFRGHFLYEGD-LKAENTDVQAL--FKDFVEEYDKT--IEES-H   LSEITVDAL---SI   211
WP_048800889    144   DTGKVDLRLIYLALAHMIKFRGHFLIEGD-LKAENTDVQTL--FKDFVEVYDKT--IEES-H   LABITVDAL---SI   211
WP_012767106    144   DSTDKADLRLIYLALAHMIKFRGHFLIEGD-LNPDNSDMDKL--FIQLVQTYNQL--FEEK-    INASRVDAK---SI   211
WP_014612333    144   DSTDKADLRLIYLALAHMIKFRGHFLIEGD-LNPDNSDVDKL--FIQLVQTYNQL--FEEN-    INASGVDAK---AI   211
WP_015017095    144   DSTDKADLRLIYLALAHMIKFRGHFLIEGD-LNPDNSDMDKL--FIQLVQTYNQL--FEEN-    INASRVDAK---SI   211
WP_015057649    144   DSTDKADLRLIVYLALAHMIKFRGHFLIEGD-LNPDNSDMDKL--FIQLVQTYNQL--FEEN-    INASRVDAK---AI   211
WP_048272715    144   DSTDKADLRLIYLALAHMIKFRGHFLIEGD-LNPDNSDMDKL--FIQLVQTYNQL--FEEN-    INASRVDAK---AI   211
WP_049519324    144   DSTDKADLRLIYLALAHMIKFRGHFLIEGT-LSSKNNNLQKS--FDHLVDTYNLL--FEEQ-    LLTEGINAK---EL   211
WP_012515931    144   DNPQKADLRLIYLAVAHIIKFRGHFLIEGT-LSSKNNNLQKS--FDHLVDTYNLL--FEEQ-    LLTEGINAK---EL   211
WP_021320964    144   DNPQKADLRLIYLAVAHIIKFRGHFLIEGT-LSSKNNNLQKS--FDHLVDTYNLL--FEEQ-    LLTEGINAK---EL   211
WP_037581760    144   DSPEKVDLRLIYLAVAHIIKFRGHFLIEGQ-LNAENTDVQKI--FADFVGVYDRT--FDDS-H   LSEITVDAA---SI   211
WP_004232481    144   DSPEKVDLRLIYLAVAHIIKFRGHFLIEGQ-LNAENTDVQKI--FADFVGVYDRT--FDDS-H   LSEITVDAA---SI   211
```

| | | -continued | | |
|---|---|---|---|---|
| WP_009854540 | 145 | DSSEKADLRLIVYLALAHMIKYRGHPFLIEGK-LNAENTDVQKL--FTDFVGVYDRT--FDDS-H | LSEITVDVA---ST | 212 |
| WP_012962174 | 145 | DSHEKADLRLIVYLALAHMIKFRGHFLIEGE-LNAENTDVQKL--FEAFVEVYDRT--FDDS-N | LSEITVDAS---SI | 212 |
| WP_039695303 | 145 | DSSEKADLRLIVYLALAHMIKFRGHFLIEGE-LNAENTDVQKI--FADFVGVYNRT--FDDS-H | LSEITVDVA---SI | 212 |
| WP_014334983 | 144 | DSQEKADLRLIYLALAHIIKFRGHFLIEGN-LDSENTDVHVL--FNVFVETYDKI--VDES-H | LSEIEVDAS---SI | 211 |
| WP_003099269 | 144 | DSDQKADLRLIYLALAHIIKFRGHFLIEGN-LDSENTDVHVL--FLNLVNIYNNL--FEED-- | VETASIDAE---KI | 211 |
| AHY15608 | 144 | DSDQKADLRLIYLALAHIIKFRGHFLIEGN-LDSENTDVHVL--FLNLVNIYNNL--FEED-- | VETASIDAE---KI | 211 |
| AHY17476 | 144 | DSDQKADLRLIYLALAHIIKFRGHFLIEGN-LDSENTDVHVL--FLNLVNIYNNL--FEED-- | VETASIDAE---KI | 211 |
| ESR09100 | | ------------------------------------------------------------ | -------------- | |
| AGM98575 | 144 | DSDQKADLRLIYLALAHIIKFRGHFLIEGN-LDSENTDVHVL--FLNLVNIYNNL--FEED-- | VETASIDAE---EI | 211 |
| ALF27331 | 144 | DNPEKTDLRLVYLALAHIIKFRGHFLIEGK-FDTRNNDVQRL--FQEFLAVYDNT--FENS-S | LQEQNVQVE---EI | 211 |
| WP_018372492 | 144 | DTPDKMDIRLIYLALAHIIKFRGHFLYEGD-LDIENIGIQDS--FKSFIEEYNTQ--FGTK-- | -LDSTTKVE---AI | 209 |
| WP_045618028 | 145 | DSKEKADFRLIYLALAHIIKFRGHFLYEES-FDIKNNDIQKI--FNEFISIYDNT--FEGS-S | LNGQNAQVE---AI | 212 |
| WP_045635197 | 144 | DSKEKTDLRLIYLALAHMIKFRGHFLYEEA-FDIKNNDIQKI--FNEFISIYDNT--FEGS-S | LSGQNAQVE---AI | 211 |
| WP_002263549 | 144 | DNPEKVDLRLIYLALAHIIKFRGHFLIEGK-FDTRNNDVQRL--FQEFLAVYDNT--FENS-S | LQEQNVQVE---EI | 211 |
| WP_002263887 | 144 | DNPEKVDLRLIYLALAHIIKFRGHFLIEGK-FDTRNNDVQRL--FQEFLAVYDNT--FENS-S | LQEQNVQVE---EI | 211 |
| WP_002264920 | 144 | DSTEKADLRLVYLALAHIIKFRGHFLIEGE-LNAENTDVQKL--FADFVGVYDRT--FDDS-H | LSEITVDAS---SI | 211 |
| WP_002269043 | 144 | DNPEKVDLRLIYLALAHIIKFRGHFLIEGK-FDTRNNDVQRL--FQEFLAVYDNT--FENS-S | LQEQNVQVE---EI | 211 |
| WP_002269448 | 144 | DSDQKADLRLIYLALAHIIKFRGHFLIEGK-LDSENTDVHVL--FLNLVNIYNNL--FEED-- | LQEQNVQVE---EI | 211 |
| WP_002271977 | 144 | DNPEKTDLRLVYLALAHIIKFRGHFLIEGK-FDTRNNDVQRL--FQEFLAVYDNT--FENS-S | LQEQNVQVE---EI | 211 |
| WP_002272766 | 144 | DNPEKVDLRLIYLALAHIIKFRGHFLIEGK-FDTRNNDVQRL--FQEFLAVYDNT--FENS-S | LQEQNVQVE---EI | 211 |
| WP_002273241 | 144 | DNPEKVDLRLIYLALAHIIKFRGHFLIEGK-FDTRNNDVQRL--FQEFLAVYDNT--FENS-S | LQEQNVQVE---EI | 211 |
| WP_002275430 | 144 | DNPEKVDLRLIYLALAHIIKFRGHFLIEGK-FDTRNNDVQRL--FQEFLAVYDNT--FENS-S | LQEQNVQVE---EI | 211 |
| WP_002276448 | 144 | DNPEKVDLRLIYLALAHIIKFRGHFLIEGK-FDTRNNDVQRL--FQEFLAVYDNT--FENS-S | LQEQNVQVE---EI | 211 |
| WP_002277050 | 144 | DSTEKADLRLVYLALAHIIKFRGHFLIEGE-LNAENTDVQKL--FADFVGVYDRT--FDDS-H | LSEITVDAS---SI | 211 |
| WP_002277364 | 144 | DNPEKVDLRLIYLALAHIIKFRGHFLIEGK-FDTRNNDVQRL--FQEFLAVYDNT--FENS-S | LQEQNVQVE---EI | 211 |
| WP_002279025 | 144 | DNPEKVDLRLIYLALAHIIKFRGHFLIEGK-FDTRNNDVQRL--FQEFLAVYDNT--FENS-S | LQEQNVQVE---EI | 211 |
| WP_002279859 | 144 | DSTEKADLRLVYLALAHIIKFRGHFLIEGE-LNAENTDVQKL--FADFVGVYDRT--FDDS-H | LSEITVDAS---SI | 211 |
| WP_002280230 | 144 | DNPEKVDLRLIYLALAHIIKFRGHFLIEGK-FDTRNNDVQRL--FQEFLAVYDNT--FENS-S | LQEQNVQVE---EI | 211 |
| WP_002281696 | 144 | DNPEKVDLRLIYLALAHIIKFRGHFLIEGK-FDTRNNDVQRL--FQEFLAVYDNT--FENS-S | LQEQNVQVE---EI | 211 |
| WP_002282247 | 144 | DSTEKADLRLVYLALAHIIKFRGHFLIEGE-LNAENTDVQKL--FADFVGVYDRT--FDDS-H | LSEITVDAS---SI | 211 |
| WP_002282906 | 144 | DNPEKVDLRLIYLALAHIIKFRGHFLIEGK-FDTRNNDVQRL--FQEFLAVYDNT--FENS-S | LQEQNVQVE---EI | 211 |
| WP_002283846 | 144 | DNPEKVDLRLIYLALAHIIKFRGHFLIEGK-FDTRNNDVQRL--FQEFLAVYDNT--FENS-S | LQEQNVQVE---EI | 211 |
| WP_002287255 | 144 | DNPEKVDLRLIYLALAHIIKFRGHFLIEGK-FDTRNNDVQRL--FQEFLAVYDNT--FENS-S | LQEQNVQVE---EI | 211 |
| WP_002288990 | 144 | DNPEKVDLRLIYLALAHIIKFRGHFLIEGK-FDTRNNDVQRL--FQEFLAVYDNT--FENS-S | LQEQNVQVE---EI | 211 |
| WP_002289641 | 144 | DNPEKVDLRLIYLALAHIIKFRGHFLIEGK-FDTRNNDVQRL--FQEFLAVYDNT--FENS-S | LQEQNVQVE---EI | 211 |
| WP_002290427 | 144 | DNPEKVDLRLIYLALAHIIKFRGHFLIEGK-FDTRNNDVQRL--FKDFVEVYDKT--VEES-H | LSEMTVDAL---SI | 211 |
| WP_002295753 | 144 | DNPEKVDLRLIYLALAHIIKFRGHFLIEGK-FDTRNNDVQRL--FQEFLAVYDNT--FENS-S | LQEQNVQVE---EI | 211 |
| WP_002296423 | 144 | DNPEKVDLRLIYLALAHIIKFRGHFLIEGK-FDTRNNDVQRL--FQEFLAVYDNT--FENS-S | LQEQNVQVE---EI | 211 |
| WP_003044487 | 144 | NSTEKADLRLVLSLAHMIKFRGHFLIEGQ-LKAENTNVQAL--FQEFLAVYDNT--FENS-S | LQEQNVQVE---EI | 211 |
| WP_003055844 | 144 | DNPEKVDLRLIYLALAHIIKFRGHFLIEGK-FDTRNNDVQRL--FQEFLAVYDNT--FENS-S | LQEQNVQVE---EI | 211 |
| WP_003072073 | 144 | DNPEKVDLRLIYLALAHIIKFRGHFLIEGK-FDTRNNDVQRL--FQEFLAVYDNT--FENS-S | LQEQNVQVE---EI | 211 |
| WP_002310390 | 144 | DNPEKVDLRLIYLALAHIIKFRGHFLIEGK-FDTRNNDVQRL--FQEFLAVYDNT--FENS-S | LQEQNVQVE---EI | 211 |
| WP_003052408 | 144 | DNPEKVDLRLIYLALAHIIKFRGHFLIEGK-FDTRNNDVQRL--FQEFLAVYDNT--FENS-S | LQEQNVQVE---EI | 211 |
| WP_012997688 | 144 | DNPEKVDLRLIYLALAHIIKFRGHFLIEGK-FDTRNNDVQRL--FQEFLAVYDNT--FENS-S | LQEQNVQVE---EI | 211 |
| WP_014677909 | 144 | DNPEKTDLRLIYLALAHIIKFRGHFLIEGE-LNAENTDVQKL--FQEFLAVYDNT--FENS-S | LQEQNVQVE---EI | 211 |
| WP_019312892 | 144 | DNPEKVDLRLIYLALAHIIKFRGHFLIEGK-FDTRNNDVQRL--FQEFLAVYDNT--FENS-S | LQEQNVQVE---EI | 211 |
| WP_019313659 | 144 | DNPEKVDLRLIYLALAHIIKFRGHFLIEGK-FDTRNNDVQRL--FQEFLAVYDNT--FENS-S | LQEQNVQVE---EI | 211 |
| WP_019314093 | 144 | DNPEKVDLRLIYLALAHIIKFRGHFLIEGK-FDTRNNDVQRL--FQEFLAVYDNT--FENS-S | LQEQNVQVE---EI | 211 |
| WP_019315370 | 144 | DNPEKVDLRLIYLALAHIIKFRGHFLIEGK-FDTRNNDVQRL--FQEFLAVYDNT--FENS-S | LQEQNVQVE---EI | 211 |
| WP_019803776 | 144 | DNPEKVDLRLIYLALAHIIKFRGHFLIEGK-FDTRNNDVQRL--FQEFLAVYDNT--FENS-S | LQEQNVQVE---EI | 211 |
| WP_019805234 | 144 | DSTEKADLRLVYLALAHIIKFRGHFLIEGE-LNAENTDVQKL--FADFVGVYDRT--FDDS-H | LSEITVDAS---SI | 211 |
| WP_024783594 | 144 | DNPEKVDLRLIYLALAHIIKFRGHFLIEGK-FDTRNNDVQRL--FQEFLAVYDNT--FENS-S | LQEQNVQVE---EI | 211 |
| WP_024784288 | 144 | DNPEKVDLRLIYLALAHIIKFRGHFLIEGK-FDTRNNDVQRL--FQEFLAVYDNT--FENS-S | LQEQNVQVE---EI | 211 |
| WP_024784666 | 144 | DNPEKVDLRLIYLALAHIIKFRGHFLIEGK-FDTRNNDVQRL--FQEFLAVYDNT--FENS-S | LQEQNVQVE---EI | 211 |

```
WP_024784894   144 DNPEKTDLRLIVYLALAHIIKFRGHFLIEGK-FDTRNNDVQRL--FQEFLAVYDNT--FENS-S   LQEQNVQVE---EI  211
WP_024786433   144 DSTEKADLRLIVYLALAHMIKFRGHFLIEGE-LNAENTDVQKL--FADFVGVYDRT--FDDS-H   LSEITVDAS---SI  211
WP_049473442   144 DNPEKVDLRLIVYLALAHIIKFRGHFLIEGK-FDTRNNDVQRL--FQEFLAVYDNT--FENS-S   LQEQNVQVE---EI  211
WP_049474547   144 DNPEKTDLRLIVYLALAHIIKFRGHFLIEGK-FDTRNNDVQRL--FQEFLAVYDNT--FENS-S   LQEQNVQVE---EI  211
EMC03581       137 DNPEKTDLRLIVYLALAHIIKFRGHFLYEDT-FDIKNNDIQKI--FNEFISIYNNT--FEGN-S   LSQQNVQVE---EI  204
WP_000428612   145 DSKEKTDLRLIYLALAHMIKYRGHFLYEDT--FDIKNNDIQKI--FSEFISIYDNT--FEGS-S   LSQQNAQVE---AI  212
WP_000428613   144 DSKEKTDLRLIYLALAHMIKYRGHFLYEDS-FDIKNNDIQKI--FNEFTLYDNT--FEES-S   LSKQNAQVE---EI  211
WP_049523028   113 DSDEKADLRLIYLALAHIIKFRGHFLIEGD-LDSQNTDVNAL--FLKLVDTYNLM--FEDD--   IDTQTIDAT---VI  180
WP_003107102   146 DNTEKADLRLIYLALAHIIKFRGHFLIEGA-LSANNTDVQQL--VHALVDAYNIM--FEDD--   LDIEAIDVK---AI  213
WP_054279288   145 DSKEKSDVRLIYLALAHMIKYRGHFLYEET-FDIKNNDIQKI--FNEFINIYDNT--FEGS-S   LSQQNAQVE---AI  212
WP_049531101   145 DSKEKTDLRLIYLTLAHMIKYRGHFLYEET-FDIKNNDIQKI--FNEFISIYDNT--FEGS-S   LSQQNEQVE---AI  212
WP_049538452   145 DSKEKADLRLIYLALAHMIKYRGHFLYEEA-FDIKNNDIQKI--FNEFINIYDNT--FEGS-S   LSQQNAQVE---AI  212
WP_049549711   146 DSKEKADLRLIYLVLAHMIKYRGHFLYEEA-FDIKNNDIQKI--FNEFISIYDNT--FEGN-S   LSQQNAQVE---TI  213
WP_007896501   98  DRDQKADLRLIYLALSHIIKERGHFLIEGK-LNSENTDVQKL--FIALVTVYNLL--FEEE--   IAGETCDAK---AL  165
EFR44625       144 DSKEKSDVRLIYLALAHMIKYRGHFLYEET-FDIKNNDIQKI--FNEFINIYDNT--FEGS-S   IAGETCDAK---AL  211
WP_002997477   144 DSKEKTDLRLIYLALAHMIKYRGHFLYEES-FDIKNNDIQKI--FNEFISIYDNT--FEGS-S   LSQQNAQVE---AI  211
WP_002906454   145 DSKEKADLRLIYLALAHMIKYRGHFLIDEP-IDIRMNSQNL--FKEFLLAPDGI--QVDC-Y   LSQQNVQVE---AI  212
WP_009729476   145 DSKEKTDLRLIYLALAHMIKYRGHFLYEES-FDIKNNDIQKI--FSEFISIYDNT--FEGK-S   LASKHTDIS---GI  211
CQR24647       145 DSKEKADLRLIYLALAHIIKYRGHFLYEEA-FDIKNNDIQKI--FNEFINIYDNT--FEGS-S   LSQQNAQVE---AI  212
WP_000066813   144 DSKEKTDLRLIYLALAHMIKYRGHFLYEES-FDIKNNDIQKI--FNEFINIYDNT--FEGS-S   LSQQNAQVE---AI  212
WP_009754323   145 DSKEKADLRLIYLALAHTTKYRGHFLYEEA-FDIKNNDIQKI--FNEFINIYDNT--FEGS-S   LSQQNAQVE---AI  212
WP_044674937   144 DSSQKADLRLIYLALAHMIKYRGHELFEGD-LKSENKDVQHL--FNDEVEMFDKT--VEGS-Y   LSENLPNVA---DV  211
WP_044676715   144 DSSQKADLRLIYLALAHMIKYRGHFLIEGD-LKSENKDVQHL--FNDEVEMFDKT--VEGS-Y   LSENLPNVA---DV  211
WP_044680361   144 DSSQKADLRLIYLALAHIIKYRGHFLIEGD-LNPDNSDVDKL--FNDEVEMFDKT--VEGS-Y   LSENLPNVA---DV  211
WP_044681799   144 DSSQKADLRLIYLALAHIIKYRGHFLIEGD-LKSENKDVQHL--FNDEVEMFDKT--VEGS-Y   LSENLPNVA---DV  211
WP_049533112   144 DISQKADLRLIVYLALAHMIKYRGHFLIEQO-LKAENTNVQAL--FKDEVEVYDKT--VEES-H   LSEMTVDAL---SI  211
WP_029090905   101 SQHRQPDIREVYLAIHHLIKYRGHFIYEDQPFTTDGNQLQHH--IKAIITMINSTL--NR-    IIPETIDINvfeKI  171
WP_006506696   140 ESTEKADPRLIYLALAHHIVKYRGNFLYEGQkFNMDASNIEDK--LSDIFTQFTSFnniPYEdD  --KKNLEIL---EI  210
AIT42264       144 DSTDKADLRLIYLALAHMIKERGHFLIEGD-LNPDNSDVDKL--FIQLVQTYNQL--FEEN--   INASGVDAK---AI  211
WP_034440723   143 DSNQKADLRLIYLALAHMIKERGHFLIEGD-LKMDGISISES--FQEFIDSYNEVcaLEDE-N  NDELLTQIE---NI  217
AKQ21048       144 DSTDKADLRLIYLALAHMIKERGHFLIEGD-LNPDNSDVDKL--FIQLVQTYNQL--FEEN--   INASGVDAK---AI  211
WP_004636532   144 DNPEKADLRLIVYTALAHIVKYRGHFLIEGE-LNTENTSISET--FEQFLDTYSDI--FKEQ-   LVGDISKVE---EI  210
WP_002364836   144 DSSEQADLRLIYLALAHIVKYRGHFLIEGK-LSTENISVKEQ--FQQFMIIYNQT--FVNGeS   PLPESVLIE---EE  217
WP_016631044   95  DSSEQADLRLIYLALAHIVKYRGHFLIEGK-LSTENISVKEQ--FQQFMIIYNQT--FVNGeS   PLPESVLIE---EE  168
EMS75795       144 DSSEQADLRLIYLALAHIVKYRGHFLIEGK-LSTENISVKEQ--FQQFMIIYNQT--FVNGeS   PLPESVLIE---EE  217
WP_002373311   144 DSSEQADLRLIYLALAHIVKYRGHFLIEGK-LSTENISVKEQ--FQQFMIIYNQT--FVNGeS   PLPESVLIE---EE  217
WP_002378009   144 DSSEQADLRLIYLALAHIVKYRGHFLIEGK-LSTENISVKEQ--FQQFMIIYNQT--FVNGeS   PLPESVLIE---EE  217
WP_002407324   144 DSSEQADLRLIYLALAHIVKYRGHFLIEGK-LSTENISVKEQ--FQQFMIIYNQT--FVNGeS   PLPESVLIE---EE  217
WP_002413717   144 DSSEQADLRLIYLALAHIVKYRGHFLIEGK-LSTENISVKEQ--FQQFMIIYNQT--FVNGeS   PLPESVLIE---EE  217
WP_010775580   144 DSSEQADLRLIYLALAHIVKYRGHFLIEGK-LSTENISVKEQ--FQQFMIIYNQT--FVNGeS   PLPESVLIE---EE  217
WP_010818269   144 DSSEQADLRLIYLALAHIVKYRGHFLIEGK-LSTENISVKEQ--FQQFMIIYNQT--FVNGeS   PLPESVLIE---EE  217
WP_010824395   144 DSSEQADLRLIYLALAHIVKYRGHFLIEGE-LNTENSSVKEK--FQQFMIIYNQT--FVNGeG   PLPESVLIE---EE  217
WP_016622645   144 DSSEQADLRLIYLALAHIVKYRGHFLIEGE-LNTENSSVTET--FQQFMIIYNQT--FVNGeS   PLPESVLIE---EE  217
WP_033624816   144 DSSEQADLRLIYLALAHIVKYRGHFLIEGE-LNTENSSVTET--FQQFMIIYNQT--FVNGeS   PLPESVLIE---EE  217
WP_033625576   144 DSSEQADLRLIYLALAHIVKYRGHFLIEGE-LNTENSSVTET--FQQFMIIYNQT--FVNGeS   PLPESVLIE---EE  217
WP_033789179   144 DSSEKADIRLIVYLAMAHLLKYRGHFLIEGE-LNTENSSVTET--FRQFLSTYNQQ--FSEA-D   KLDEAVDCS---FV  216
WP_002310644   144 DSSEKADIRLIVYLAMAHLLKYRGHFLIEGE-LNTENSSVTET--FRQFLSTYNQQ--FSEA-G   KLDEAVDCS---FV  216
WP_002312694   144 DSSEKADIRLIVYLAMAHLLKYRGHFLIEGE-LNTENSSVTET--FRQFLSTYNQQ--FSEA-D   KLDEAVDCS---FV  216
WP_002314015   144 DSSEKADIRLIVYLAMAHLLKYRGHFLIEGE-LNTENSSVTET--FRQFLSTYNQQ--FSEA-D   KLDEAVDCS---FV  216
WP_002320716   144 DSSEKADIRLIVYLAMAHLLKYRGHFLIEGE-LNTENSSVTET--FRQFLSTYNQQ--FSEA-D   KLDEAVDCS---FV  216
WP_002330729   144 DSSEKADIRLIVYLAMAHLLKYRGHFLIEGE-LNTENSSVTET--FRQFLSTYNQQ--FSEA-D   KLDEAVDCS---FV  216
WP_002335161   144 DSSEKADIRLIVYLAMAHLLKYRGHFLIEGE-LNTENSSVTET--FRQFLSTYNQQ--FSEA-D   KLDEAVDCS---FV  216
WP_002345439   144 DSSEKADIRLIVYLAMAHLLKYRGHFLIEGE-LNTENSSVTET--FRQFLSTYNQQ--FSEA-D   KLDEAVDCS---FV  216
WP_034867970   144 DSTEKEDLRLIVYLAMAHLLKYRGHFLFEGD-LDTENTSIEES--FRVFLEQYSKQ--SDQP--   -LIVHQPVL---TI  209
```

-continued

```
WP_047937432  144  DSSEKADIRLVYLAMAHLLKYRGHFLIEGE-LNTENSSVTET--FRQFLSTYNQQ--FSEA-D  KLDEAVDCS---FV  216
WP_010720994  144  DSTEKGDLRLVYLALAHLLKYRGHFLFEGD-LDTENTSIEES--FRVFLEQYGKQ--SDQP--  -LIVHQPVL---TI  209
WP_010737004  144  DSTEKEDLRLVYLALAHLLKYRGHFLFEGD-LDTENTSIEES--FRVFLEQYSKQ--SDQP--  -LIVHQPVL---TI  209
WP_034700478  144  DSTEKEDLRLVYLALAHIIKFRGHFLFEGD-LDTENTSIEES--FRVFLEQYGKQ--SDQP--  -LIVHQPVL---TI  209
WP_007209003  144  DGDEKADLRLVYLALAHIIKFRGNFLIEGE-LNTENNSVIELs--KVFVQLYNQT1-SELE--  FIDESIDFS---EV  214
WP_023519017  144  NSKEQADIRLVYLAIAHCLKYRGHFLFEGE-LDTENTSVTEN--YQQFLQAYQQF--FPEP--  -IGDLDDAV---PI  209
WP_010770040  144  DTSEQADLRLVYLALAHIVKYRGHFLIEGE-LNTENSSVSET--FRTFIQVYNQI--FRENe-  PLAVPDNIE---EL  212
WP_048604708  144  DAEEKADLRLVYLALAHIVKYRGHFLIEGA-LSTENTSTET--FKTFLQKYNQT--FN---  PVDETISIG---SI  208
WP_010750235  144  DSTEKADIRLVYLALAHMIKYRGHFLFEGE-LDTENTSVEET--FKEFIDIYNEQ--FEEG--  -IIFYKDIP---LI  209
AII16583      183  DSTDKADLRLIYLALAHMIKFRGHFLIEGD-LNPDNSDVDKL--FIQLVQTYNQL--FEEN--  INASGVDAK---AI  250
WP_029073316  145  ESKEKEEDPRLIYLALHHIVKYRGNFLYEGQkFSMDVSNIEDK--MIDVLRQFNEInlFEYveD  --KKIDEVL---NV  215
WP_031589969  145  ESKEKEEDPRLIYLALHHIVKYRGNFLYEGQkFSMDVSNIEDK--MIDVLRQFNEInlFEYveD  --KKIDEVL---NV  215
KDA45870      145  NNDRPADLRLVYLALAHIIKYRGNFLLEGE-IDLRTTDINKV--FAEFSETLNEN--SDEN1G  ---KLDVA---DI  209
WP_039099354  133  TEKRQPDIREIYLAMHHIVKYRGHFLNEAPvSsEKSSEINLVahFDRLNTIFADL--FSESgF  -TDKLAEVK---AL  206
AKP02966      138  INKNKADIRLVYLALHNILKYRGHFLFEGE-KELIELNQQlikYDIS--  -FPDNCDWNhisDI  208
WP_010991369  144  NSSEKADLRLVYLALAHIIKYRGNFLIEGA-LDTQNTSVDGI--YKQFIQTYNQV--FASGiE  KLEDNKDVA---KI  217
WP_033838504  144  NSSEKADLRLVYLALAHIIKYRGNFLIEGA-LDTQNTSVDGI--YKQFIQTYNQV--FASGiE  KLEDNKDVA---KI  217
EHN60060      147  NSSEKADLRLVYLALAHIIKYRGNFLIEGA-LDTQNTSVDGI--YKQFIQTYNQV--FASGiE  KLEDNKDVA---KI  220
EFR89594                                                                                                        
WP_038409211  144  NSSDKADLRLVYLALAHIIKYRGNFLIEGM-LDTKNTSVDEV--FKQFIQTYNQI--FASDiE  RLEENKEVA---EI  217
EFR_95520                                                                                                       
WP_003723650  144  NSSEKADLRLVYLALAHIIKYRGNFLIEGA-LDTKNTSVDEV--YKQFIETYNQV--FMSNiE  KVEENTEVA---NI  217
WP_003727705  144  NSSEKADLRLIYLALAHMIKYRGNFLIEGA-LDTKNTSVDEV--YKQFIQTYNQV--FMSNiE  KVEENTEVA---SI  217
WP_003730785  144  NSSEKADLRLVYLALAHIIKYRGNFLIEGA-LDTKNTSVDEV--YKQFIQTYNQV--FMSNiE  KVEENTEVA---SI  217
WP_003733029  144  DSQKKADLRLVYLALAHIIKYRGNFLIEGA-LDTKNTSIDEM--FKQFIQTYNQV--FANDiE  KTERNQEVA---QI  217
WP_003739838  144  NSSEKADLRLVYLALAHIIKYRGNFLIEGA-LDTKNTSVDGV--YKQFIQTYNQV--FlSNiE  KMEENTTVA---DI  217
WP_014601172  144  NSSEKADLRLIYLALAHIIKYRGNFLIEGA-LDTKNTSVDGV--YEQFILTYNQV--FMSNiE  KVEENIEVA---NI  217
WP_023548323  144  NSSEKADLRLVYLALAHIIKYRGNFLIEGA-LDTKNTSVDGI--YEQFIQTYNQV--FMSNiE  KVEENIEVA---AI  217
WP_031665337  144  NSSEKADLRLVYLALAHIIKYRGNFLIEGA-LDTKNTSVDGV--YEQFIQTYNQV--FMSNiE  KVEENIEVA---NI  217
WP_031669209  144  DSQKKADLRLVYLALAHIIKYRGNFLIEGA-LDTKNTSIDEM--FKQFLQIYNQV--YEQFIQTYNQV--FMSNiE  KTEKNQEVA---QI  217
WP_033920898  144  NSSEKADLRLVYLALAHIIKYRGNFLIEGA-LDTKNTSVDGV--YEQFIQTYNQV--FMSNiE  KVEENIEVA---NI  217
AKI42028      147  NSSEKADLRLVYLALAHIIKYRGNFLIEGA-LDTKNTSVDGV--YEQFIQTYNQV--FMSNiE  KVEENIEVA---AI  220
AKI50529      147  NSSEKADLRLVYLALAHIIKYRGNFLIEGA-LDTKNTSVDGV--YEQFIQTYNQV--FMSNiE  KVEENIEVA---AI  220
EFR83390                                                                                                        
WP_046323366  144  NSSDKADLRLVYLALAHIIKYRGNFLIEGK-LDTKNTSVDEV--FKQFIKTYNQV--FASDiE  RIEENNEVA---KI  217
AKE81011      160  DSTDKADLRLIYLALAHMIKFRGHFLIEGD-LNPDNSDVDKL--FIQLVQTYNQL--FEEN--  INASGVDAK---AI  227
CUO82355      144  ESTEKADLRLIYLALHHIVKYRGHFLYEGQkFPNMDASNIEDK--LSDVTFQFADFnniPYEdD  --KKNLEIL---EI  214
WP_033162887  145  ENKEKADPRLIYLALHHIVKYRGNFLYEGQsFTMDNSDIEER--LNSAIEKFMSInefDNRiV  --SDINSMI---AV  215
AGZ01981      177  DSTDKADLRLIYLALAHMIKFRGHFLIEGD-LNPDNSDVDKL--FIQLVQTYNQL--FEEN--  INASGVDAK---AI  244
AKA60242      144  DSTDKADLRLIYLALAHMIKFRGHFLIEGD-LNPDNSDVDKL--FIQLVQTYNQL--FEEN--  INASGVDAK---AI  211
AKS40380      144  DSTDKADLRLIYLALAHMIKFRGHFLIEGD-LNPDNSDVDKL--FIQLVQTYNQL--FEEN--  INASGVDAK---AI  211
4UN5_B        148  DSTDKADLRLIYLALAHMIKFRGHFLIEGD-LNPDNSDVDKL--FIQLVQTYNQL--FEEN--  INASGVDAK---AI  215

WP_010922251  212  LSAR-LSKSRRLENLIAQ-L-PG  EKKNGLFGNLIALSLGLITPNFKSNF--DLAED[E]---KLQ--LSKDTYDDDLDN  277

WP_039995303  213  LTEK-ISKSRRLENLIKY-Y-PT  EKKNTLFGNLIALSLGLTPNFKTNF--KLsED-A---KLQ--FSKDTYEEDLEE  278
WP_045635197  212  FTDK-ISKSAKRERVLKL-F-PD  EKSTGLFSEFLKLIVGNQADFKKHF--DLEDK-A---PLQ--FSKDTYDEDLEN  277
5AXW_A        135  LSTK------EQISRN-S--K  ----LEEKyVa--ELQ--  157
WP_009880683                                                                                                    
WP_010922251  212  LSAR-LSKSRRLENLIAQ-L-PG  EKKNGLFGNLIALSLGLTPNFKSNF--DLAED-A---KLQ--LSKDTYDDDLDN  277
WP_011054416  212  LSAR-LSKSRRLENLIAQ-L-PG  EKKNGLFGNLIALSLGLTPNFKSNF--DLAED-A---KLQ--LSKDTYDDDLDN  277
WP_011284745  212  LSAR-LSKSRRLENLIAQ-L-PG  EKKNGLFGNLIALSLGLTPNFKSNF--DLAED-A---KLQ--LSKDTYDDDLDN  277
WP_011285506  212  LSAR-LSKSRRLENLIAQ-L-PG  EKKNGLFGNLIALSLGLTPNFKSNF--DLAED-A---KLQ--LSKDTYDDDLDN  277
WP_011527619  212  LSAR-LSKSRRLENLIAQ-L-PG  EKKNGLFGNLIALSLGLTPNFKSNF--DLAED-A---KLQ--LSKDTYDDDLDN  277
```

```
WP_012560673   212  LSAR-LSKSRRLENLIAQ-L-PG   EKKNGLFGNLIALSLGLTPNFKSNF-DLAED-A---KLQ--LSKDTYDDDLDN   277
WP_014407541   212  LSAR-LSKSRRLENLIAQ-L-PG   EKRNGLFGNLIALSLGLTPNFKSNF-DLAED-A---KLQ--LSKDTYDDDLDN   277
WP_020905136   212  LSAR-LSKSRRLENLIAQ-L-PG   EKKNGLFGNLIALSLGLTPNFKSNF-DLAED-A---KLQ--LSKDTYDDDLDN   277
WP_023080005   212  LSAR-LSKSRRLENLIAQ-L-PG   EKKNGLFGNLIALSLGLTPNFKSNF-DLAED-A---KLQ--LSKDTYDDDLDN   277
WP_023610282   212  LSAR-LSKSRRLENLIAQ-L-PG   EKKNGLFGNLIALSLGLTPNFKSNF-DLAED-A---KLQ--LSKDTYDDDLDN   277
WP_030125963   212  LSAR-LSKSRRLENLIAQ-L-PG   EKKNGLFGNLIALSLGLTPNFKSNF-DLAED-A---KLQ--LSKDTYDDDLDN   277
WP_030126706   212  LSAR-LSKSRRLENLIAQ-L-PG   EKKNGLFGNLIALSLGLTPNFKSNF-DLAED-A---KLQ--LSKDTYDDDLDN   277
WP_031488318   212  LSAR-LSKSRRLENLIAQ-L-PG   EKKNGLFGNLIALSLGLTPNFKSNF-DLAED-A---KLQ--LSKDTYDDDLDN   277
WP_032460140   212  LSAR-LSKSRRLENLIAQ-L-PG   EKKNGLFGNLIALSLGLTPNFKSNF-DLAED-A---KLQ--LSKDTYDDDLDN   277
WP_032461047   212  LSAR-LSKSRRLENLIAQ-L-PG   EKKNGLFGNLIALSLGLTPNFKSNF-DLAED-A---KLQ--LSKDTYDDDLDN   277
WP_032462016   212  LSAR-LSKSRRLENLIAQ-L-PG   EKKNGLFGNLIALSLGLTPNFKSNF-DLAED-A---KLQ--LSKDTYDDDLDN   277
WP_032462936   212  LSAR-LSKSRRLENLIAQ-L-PG   EKKNGLFGNLIALSLGLTPNFKSNF-DLAED-A---KLQ--LSKDTYDDDLDN   277
WP_032464890   212  LSAR-LSKSRRLENLIAQ-L-PG   EKKNGLFGNLIALSLGLTPNFKSNF-DLAED-A---KLQ--LSKDTYDDDLDN   277
WP_033888930    37  LSAR-LSKSRRLENLIAQ-L-PG   EKKNGLFGNLIALLLGLTPNFKSNF-DLAED-A---KLQ--LSKDTYDDDLDN   102
WP_038431314   212  LSAR-LSKSRRLENLIAQ-L-PG   EKKNGLFGNLIALSLGLTPNFKSNF-DLAED-T---KLQ--LSKDTYDDDLDN   277
WP_038432938   212  LSAR-LSKSRRLENLIAQ-L-PG   EKKNGLFGNLIALSLGLTPNFKSNF-DLAED-A---KLQ--LSKDTYDDDLDN   277
WP_038434062   212  LSAR-LSKSRRLENLIAQ-L-PG   EKRNGLFGNLIALSLGLTPNFKSNF-DLAED-A---KLQ--LSKDTYDDDLDN   277
BAQ51233       123  LSAR-LSKSRRLENLIAQ-L-PG   EKKNGLFGNLIALSLGLTPNFKSNF-DLAED-A---KLQ--LSKDTYDDDLDN   188
KGE60162                                     ------------------------------------------------
KGE60856       212  LSAR-LSKSRRLENLIAQ-L-PG   EKKNGLFGNLIALSLGLTPNFKSNF-DLAED-A---KLQ--LSKDTYDDDLDN   277
WP_002989955   212  LTEK-VSKSRRLENLIAH-Y-PA   EKKNTLFGNLIALSLGLQPNFKTNF-QLSED-A---KLQ--FSKDTYEEDLEG   277
WP_003030002   215  LTDK-ISKSAKKDRILAQ-Y-PT   QKSTGIFAEFLKLIVGNQADFKKHF-KLSED-A---KLQ--FSKDSYEEDLGE   280
WP_003065552   213  LTDK-ISKSAKKDRILAQ-Y-PN   QKSTGIFAEFLKLIVGNQADFKKHF-NLEDK-T---PLQ--FAKDSYDEDLEN   278
WP_001040076   213  LTDK-ISKSAKKDRILAQ-Y-PN   QKSTGIFAEFLKLIVGNQADFKKYF-NLEDK-T---PLQ--FAKDSYDEDLEN   278
WP_001040078   213  LTDK-ISKSAKKDRILAQ-Y-PN   QKSTGIFAEFLKLIVGNQADFKKYF-NLEDK-T---PLQ--FAKDSYDEDLEN   278
WP_001040080   213  LTDK-ISKSAKKDRILAQ-Y-PN   QKSTGIFAEFLKLIVGNQADFKKYF-NLEDK-T---PLQ--FAKDSYDEDLEN   278
WP_001040081   213  LTDK-ISKSAKKDRILAQ-Y-PN   QKSTGIFAEFLKLIVGNQADFKKYF-NLEDK-T---PLQ--FAKDSYDEDLEN   278
WP_001040083   213  LTDK-ISKSAKKDRILAQ-Y-PN   QKSTGIFAEFLKLIVGNQADFKKYF-NLEDK-T---PLQ--FAKDSYDEDLEN   278
WP_001040085   213  LTDK-ISKSAKKDRILAQ-Y-PN   QKSTGIFAEFLKLIVGNQADFKKYF-NLEDK-T---PLQ--FAKDSYDEDLEN   278
WP_001040087   213  LTDK-ISKSAKKDRILAQ-Y-PN   QKSTGIFAEFLKLIVGNQADFKKYF-NLEDK-T---PLQ--FAKDSYDEDLEN   278
WP_001040088   213  LTDK-ISKSAKKDRILAQ-Y-PN   QKSTGIFAEFLKLIVGNQADFKKYF-NLEDK-T---PLQ--FAKDSYDEDLEN   278
WP_001040089   213  LTDK-ISKSAKKDRILAQ-Y-PN   QKSTGIFAEFLKLIVGNQADFKKHF-NLEDK-T---PLQ--FAKDSYDEDLEN   278
WP_001040090   213  LTDK-ISKSAKKDRILAQ-Y-PN   QKSTGIFAEFLKLIVGNQADFKKHF-NLEDK-T---PLQ--FAKDSYDEDLEN   278
WP_001040091   213  LTDK-ISKSAKKDRILAQ-Y-PN   QKSTGIFAEFLKLIVGNQADFKKYF-NLEDK-T---PLQ--FAKDSYDEDLEN   278
WP_001040092   213  LTDK-ISKSAKKDRILAQ-Y-PN   QKSTGIFAEFLKLIVGNQADFKKYF-NLEDK-T---PLQ--FAKDSYDEDLEN   278
WP_001040094   213  LTDK-ISKSAKKDRILAQ-Y-PN   QKSTGIFAEFLKLIVGNQADFKKHF-NLEDK-T---PLQ--FAKDSYDEDLEN   278
WP_001040095   213  LTDK-ISKSAKKDRILAR-Y-PN   QKSTGIFAEFLKLIVGNQADFKKHF-NLEDK-T---PLQ--FAKDSYDEDLEN   278
WP_001040096   213  LTDK-ISKSAKKDRILAR-Y-PN   QKSTGIFAEFLKLIVGNQADFKKHF-NLEDK-T---PLQ--FAKDSYDEDLEN   278
WP_001040097   213  LTDK-ISKSAKKDRILAR-Y-PN   QKSTGIFAEFLKLIVGNQADFKKHF-NLEDK-T---PLQ--FAKDSYDEDLEN   278
WP_001040098   213  LTDK-ISKSAKKDRILAQ-Y-PN   QKSTGIFAEFLKLIVGNQADFKKHF-NLEDK-T---PLQ--FAKDSYDEDLEN   278
WP_001040099   213  LTDK-ISKSAKKDRILAQ-Y-PN   QKSTGIFAEFLKLIVGNQADFKKHF-NLEDK-T---PLQ--FAKDSYDEDLEN   278
WP_001040100   213  LTDK-ISKSAKKDRILAQ-Y-PN   QKSTGIFAEFLKLIVGNQADFKKHF-NLEDK-T---PLQ--FAKDSYDEDLEN   278
WP_001040104   213  LTDK-ISKSAKKDRILAQ-Y-PN   QKSTGIFAEFLKLIVGNQADFKKHF-NLEDK-T---PLQ--FAKDSYDEDLEN   278
WP_001040105   213  LTDK-ISKSAKKDRILAQ-Y-PN   QKSTGIFAEFLKLIVGNQADFKKHF-NLEDK-T---PLQ--FAKDSYDEDLEN   278
WP_001040106   213  LTDK-ISKSAKKDRILAQ-Y-PN   QKSTGIFAEFLKLIVGNQADFKKHF-NLEDK-T---PLQ--FAKDSYDEDLEN   278
WP_001040107   213  LTDK-ISKSAKKDRILAQ-Y-PN   QKSTGIFAEFLKLIVGNQADFKKHF-NLEDK-T---PLQ--FAKDSYDEDLEN   278
WP_001040108   213  LTDK-ISKSAKKDRILAQ-Y-PN   QKSTGIFAEFLKLIVGNQADFKKHF-NLEDK-T---PLQ--FAKDSYDEDLEN   278
WP_001040109   213  LTDK-ISKSAKKDRILAQ-Y-PN   QKSTGIFAEFLKLIVGNQADFKKHF-NLEDK-T---PLQ--FAKDSYDEDLEN   278
WP_001040110   213  LTDK-ISKSAKKDRILAQ-Y-PN   QKSTGIFAEFLKLIVGNQADFKKHF-NLEDK-T---PLQ--FAKDSYDEDLEN   278
WP_015058523   213  LTDK-ISKSAKKDRILAQ-Y-PN   QKSTGIFAEFLKLIVGNQADFKKHF-NLEDK-T---PLQ--FAKDSYDEDLEN   278
WP_017643650   213  LTDK-ISKSAKKDRILAQ-Y-PN   QKSTGIFAEFLKLIVGNQADFKKHF-NLEDK-T---PLQ--FAKDSYDEDLEN   278
WP_017647151   213  LTDK-ISKSAKKDRILAQ-Y-PN   QKSTGIFAEFLKLIVGNQADFKKHF-NLEDK-T---PLQ--FAKDSYDEDLEN   278
WP_017648376   213  LTDK-ISKSAKKDRILAQ-Y-PN   QKSTGIFAEFLKLIVGNQADFKKHF-NLEDK-T---PLQ--FAKDSYDEDLEN   278
WP_017649527   213  LTDK-ISKSAKKDRILAQ-Y-PN   QKSTGIFAEFLKLIVGNQADFKKYF-NLEDK-T---PLQ--FAKDSYDEDLEN   278
```

| Accession | Pos | Sequence | End |
|---|---|---|---|
| WP_017771611 | 213 | LTDK-ISKSAKKDRILAQ-Y-PN QKSTGIFAEFLKLIVGNQADFKKHF-NLEDK-T---PLQ--FAKDSYDEDLEN | 278 |
| WP_017771984 | 213 | LTDK-ISKSAKKDRILAQ-Y-PN QKSTGIFAEFLKLIVGNQADFKKYF-NLEDK-T---PLQ--FAKDSYDEDLEN | 278 |
| CFQ25032 | 213 | LTDK-ISKSAKKDRILAQ-Y-PN QKSTGIFAEFLKLIVGNQADFKKYF-NLEDK-T---PLQ--FAKDSYDEDLEN | 278 |
| CFV16040 | 213 | LTDK-ISKSAKKDRILAQ-Y-PN QKSTGIFAEFLKLIVGNQADFKKHF-NLEDK-T---PLQ--FAKDSYDEDLEN | 278 |
| KLJ37842 | 213 | LTDK-ISKSAKKDRILAQ-Y-PN QKSTGIFAEFLKLIVGNQADFKKYF-NLEDK-T---PLQ--FAKDSYDEDLEN | 278 |
| KLJ72361 | 213 | LTDK-ISKSAKKDRILAQ-Y-PN QKSTGIFAEFLKLIVGNQADFKKYF-NLEDK-T---PLQ--FAKDSYDEDLEN | 278 |
| KLL20707 | 213 | LTDK-ISKSAKKDRILAQ-Y-PN QKSTGIFAEFLKLIVGNQADFKKYF-NLEDK-T---PLQ--FAKDSYDEDLEN | 278 |
| KLL42645 | 213 | LTDK-ISKSAKKDRILAQ-Y-PN QKSTGIFAEFLKLIVGNQADFKKYF-NLEDK-T---PLQ--FAKDSYDEDLEN | 278 |
| WP_047207273 | 213 | LTDK-ISKSAKKDRILAR-Y-PN QKSTGIFAEFLKLIVGNQADFKKYF-NLEDK-T---PLQ--FAKDSYDEDLEN | 278 |
| WP_047209694 | 213 | LTDK-ISKSAKKDRILAQ-Y-PN QKSTGIFAEFLKLIVGNQADFKKYF-NLEDK-T---PLQ--FAKDSYDEDLEN | 278 |
| WP_050198062 | 213 | LTDK-ISKSAKKDRILAQ-Y-PN QKSTGIFAEFLKLIVGNQADFKKYF-NLEDK-T---PLQ--FAKDSYDEDLEN | 278 |
| WP_050201642 | 213 | LTDK-ISKSAKKDRILAQ-Y-PN QKSTGIFAEFLKLIVGNQADFKKYF-NLEDK-T---PLQ--FAKDSYDEDLEN | 278 |
| WP_050204027 | 213 | LTDK-ISKSAKKDRILAQ-Y-PN QKSTGIFAEFLKLIVGNQADFKKYF-NLEDK-T---PLQ--FAKDSYDEDLEN | 278 |
| WP_050881965 | 213 | LTDK-ISKSAKKDRILAQ-Y-PN QKSTGIFAEFLKLIVGNQADFKKYF-NLEDK-T---PLQ--FAKDSYDEDLEN | 278 |
| WP_050886065 | 213 | LTDK-ISKSAKKDRILAQ-Y-PN QKSTGIFAEFLKLIVGNQADFKKYF-NLEDK-T---PLQ--FAKDSYDEDLEN | 278 |
| AHN30376 | 213 | LTDK-ISKSAKKDRILAQ-Y-PN QKSTGIFAEFLKLIVGNQADFKKYF-NLEDK-T---PLQ--FAKDSYDEDLEN | 278 |
| EAO78426 | 213 | LTDK-ISKSAKKDRILAQ-Y-PD QKSTGIFAEFLKLIVGNQADFKKHF-NLEDK-T---PLQ--FAKDSYDEDLEN | 278 |
| CCW42055 | 213 | LTEK-VSKSRRLENLIAH-Y-PA EKKNTLFGNLIALPLGLQPNFKTNF-QLSED-A---KLQ--FSKDTYEEDLEG | 277 |
| WP_003041502 | 213 | LTEK-VSKSRRLENLIAH-Y-PT EKKNTLFGNLIALSLGLQPNFKTNF-QLSED-A---KLQ--FSKDTYEEDLEE | 278 |
| WP_037593752 | 213 | LTEK-VSKSRRLENLIVEC-Y-PT EKKNTLFGNLIALSLGLQPNFKTNF-QLSED-A---KLQ--FSKDTYEEDLEG | 278 |
| WP_049516684 | 213 | LTEK-VSKSRRLENLIAH-Y-PT EKKNTLFGNLIALALGLGLQPNFKTNF-QLSED-A---KLQ--FSKDTYEEDLEE | 277 |
| GAD46167 | 213 | LSAR-LSKSRRLEKLIAV-F-PN EKKNGLFGNIIALALGLLTPNFKSNF-DLTED-A---LSKDTYDDDLDE | 278 |
| WP_018363470 | 213 | LTEK-VSKSRRLENLIAH-Y-PT EKKNTLFGNLIALALGLLTPNFKSNF-QLSED-A---LSKDTYDDDLDN | 277 |
| WP_003043819 | 213 | LSAR-LSKSRRLEKLIAV-F-PN EKKNGLFGNIIALALGLLTPNFKSNF-DLTED-A---LSKDTYDDDLDE | 278 |
| WP_006269658 | 212 | LTEK-VSKSRRLENLIAH-Y-PT EKKNGLFGNLIALSLGLLTPNFKSNF-QLSED-A---LSKDTYDDDLDN | 277 |
| WP_048800889 | 213 | LTEK-VSKSRRLENLIVKC-Y-PT EKRNGLFGNLIALSLGLQPNFKTNF-DLAED-A---LSKDTYDDDLDN | 277 |
| WP_012767106 | 212 | LSAR-LSKSRRLENLIAQ-L-PG LSAR-LSKSRRLENLIAQ-L-PG EKRNGLFGNLIALSLGLLTPNFKSNF-DLAED-A---LSKDTYDDDLDN | 278 |
| WP_014612333 | 212 | LSAR-LSKSRRLENLIAQ-L-PG EKRNGLFGNLIALSLGLLTPNFKSNF-DLAED-A---LSKDTYDDDLDN | 278 |
| WP_015017095 | 212 | LSAR-LSKSRRLENLIAQ-L-PG EKRNGLFGNLIALSLGLLTPNFKSNF-DLAED-A---LSKDTYDDDLDN | 278 |
| WP_015057649 | 212 | LSAR-LSKSRRLENLIAQ-L-PG EKRNGLFGNLIALSLGLLTPNFKSNF-GLSKD-V---KLQ--LAKDTYADDLDS | 277 |
| WP_048272215 | 212 | LSAR-LSKSRRLENLIAQ-L-PG EKRNGLFGNIIALSLGLLTPNFKANF-GLSKD-V---KLQ--LAKDTYADDLDS | 277 |
| WP_049519324 | 212 | LSAA-LSKSRRLENLISL-I-PG QKKTGIFGNIIALSLGLLTPNFKANF-GLSKD-V---KLQ--LAKDTYADDLDS | 277 |
| WP_012515931 | 212 | LSAA-LSKSRRLENLISL-I-PG QKKTGIFGNIIALSLGLLTPNFKANF-GLSKD-V---KLQ--LAKDTYADDLDS | 277 |
| WP_021320964 | 212 | LSAA-LSKSRRLENLISL-I-PG QKKTGIFGNIIALSLGLLTPNFKANF-GLSKD-V---KLQ--LAKDTYADDLDS | 278 |
| WP_037581760 | 212 | LTEK-LSKSRRLENLIKQ-Y-PT EKKNTLFGNLVALALGLQPNFKMNF-KLSED-A---KLQ--FSKDTYEEDLEE | 278 |
| WP_004232481 | 213 | LTEK-ISKSRRLENLIKQ-Y-PT EKKNTLFGNLIALALGLQPNFKMNF-KLSED-A---KLQ--FSKDTYEEDLEE | 278 |
| WP_009854540 | 213 | LTEK-ISKSRRLENLIKY-Y-PT EKKNTLFGNLIALALGLQPNFKTNF-KLSED-A---KLQ--FSKDTYEEDLEE | 278 |
| WP_012962174 | 213 | LTEK-FSKSRRLENLIKH-Y-PT EKKNTLFGNLIALALGLQPNFKTSF-KLSED-A---KLQ--FSKDTYEEDLEE | 278 |
| WP_039695303 | 213 | LTEK-ISKSRRLENLIKY-Y-PT EKKNTLFGNLIALALGLLTPNFKTNF-KLSED-A---KLQ--FSKDTYEEDLEE | 278 |
| WP_014334983 | 212 | LTEK-VSKSRRLENLIKQ-Y-PT EKKNGLFGNLIALALGLLTPNFKTNF-ELLED-A---KLQ--ISKDSYEEDLDN | 277 |
| WP_003099269 | 212 | LTSK-ISKSRRLENLIAE-I-PN QKRNMLFGNLVSLALGLLTPNFKTNF-ELLED-A---KLQ--ISKDSYEEDLDN | 278 |
| AHY15608 | 212 | LTSK-TSKSRRLENLIAE-I-PN QKRNMLFGNLVSLALGLLTPNFKTNF-ELLED-A---KLQ--ISKDSYEEDLDN | 278 |
| AHY17476 |  |  |  |
| ESR09100 |  |  |  |
| AGM98575 | 212 | LTSK-TSKSRRLENLIAE-I-PN QKRNMLFGNLVSLALGLLTPNFKTNF-ELLEK-A---PLQ--FSKDTYEEELEV | 277 |
| ALF27331 | 212 | LTDK-ISKSAKKDRVLKL-F-PN EKSNGRFAEFLKLIVGNQADFKKHF-ELEEK-A---PLQ--FSKDTYEEELEV | 277 |
| WP_018372492 | 210 | FTEN-SSKAKRVETILGL-F-PD ETAAGNLDKFKLKLMLGNQADFKKVF-DLEEK-----iTLQ--FSKDSYEEDLEL | 275 |
| WP_045618028 | 213 | FTDK-ISKSAKRERVLKL-F-PD EKSTGLFSEFLKLIVGNQADFKKHF-DLEEK-A---PLQ--FSKDTYEDLEN | 278 |
| WP_045635197 | 212 | FTDK-ISKSAKKDRVLKL-F-PN EKSNGRFAEFLKLIVGNQADFKKHF-DLEEK-A---PLQ--FSKDTYEEELEV | 277 |
| WP_002263549 | 212 | LTDK-ISKSAKKDRVLKL-F-PN EKSNGRFAEFLKLIVGNQADFKKHF-ELEEK-A---PLQ--FSKDTYEEELEV | 277 |
| WP_002263887 | 212 | LTDK-ISKSAKKDRVLKL-F-PN EKSNGRFAEFLKLIVGNQADFKKHF-ELEEK-A---PLQ--FSKDTYEEELEV | 277 |
| WP_002264920 | 212 | LTDK-ISKSAKKDRVLKL-F-PN EKSNTLFRNLVALSLGLLTPNFKTNF-ELEEK-A---PLQ--FSKDIYEEELEV | 277 |
| WP_002269043 | 212 | LTDK-ISKSAKKDRVLKL-F-PN EKSNGRFAEFLKLIVGNQADFKKHF-ELEEK-A---PLQ--FSKDTYEEELEV | 277 |
| WP_002269448 | 212 | LTDK-ISKSAKKDRVLKL-F-PN EKSNGRFAEFLKLIVGNQADFKKHF-ELEEK-A---PLQ--FSKDTYEEELEV | 277 |

-continued

```
WP_002271977    212 LTDK-ISKSAKKDRVLKL-F-PN  EKSNGRFAEFLKLIVGNQADFKKHF--ELEEK-A---PLQ--FSKDTYEEDLEE  277
WP_002272766    212 LTDK-ISKSAKKDRVLKL-F-PN  EKSNGRFAEFLKLIVGNQADFKKHF--ELEEK-A---PLQ--FSKDTYEEELEE  277
WP_002273241    212 LTDK-ISKSAKKDRVLKL-F-PN  EKSNGRFAEFLKLIVGNQADFKKHF--ELEEK-A---PLQ--FSKDTYEEELEV  277
WP_002275430    212 LTDK-ISKSAKKDRVLKL-F-PN  EKSNGRFAEFLKLIVGNQADFKKHF--ELEEK-A---PLQ--FSKDTYEEELEV  277
WP_002276448    212 LTDK-ISKSAKKDRVLKL-F-PN  EKKNTLFGNLIALSLGLQPNFKTNF--ELEEK-A---PLQ--FSKDTYEEELEV  277
WP_002277050    212 LTEK-ISKSRRLEKLINN-Y-PK  EKKNTLFGNLIALSLGLQPNFKTNF--KLSED-A---KLQ--FSKDTYEEDLEE  277
WP_002277364    212 LTDK-ISKSAKKDRVLKL-F-PN  EKSNGRFAEFLKLIVGNQADFKKHF--ELEEK-A---PLQ--FSKDTYEEELEV  277
WP_002279025    212 LTDK-ISKSAKKDRVLKL-F-PN  EKSNGRFAEFLKLIVGNQADFKKHF--ELEEK-A---PLQ--FSKDTYEEELEV  277
WP_002279859    212 LTEK-ISKSRRLEKLINN-Y-PK  EKSNGRFAEFLKLIVGNQADFKKHF--KLSED-A---KLQ--FSKDTYEEELEV  277
WP_002280230    212 LTDK-ISKSAKKDRVLKL-F-PN  EKSNGRFAEFLKLIVGNQADFKKHF--ELEEK-A---PLQ--FSKDTYEEELEV  277
WP_002281696    212 LTDK-ISKSAKKDRVLKL-F-PN  EKSNGRFAEFLKLIVGNQADFKKHF--ELEEK-A---PLQ--FSKDTYEEELEV  277
WP_002282247    212 LTEK-ISKSRRLEKLINN-Y-PK  EKKNTLFGNLIALSLGLQPNFKTNF--KLSED-A---KLQ--FSKDTYEEDLEE  277
WP_002282906    212 LTDK-ISKSAKKDRVLKL-F-PN  EKSNGRFAEFLKLIVGNQADFKKHF--ELEEK-A---PLQ--FSKDTYEEELEV  277
WP_002283846    212 LTDK-ISKSAKKDRVLKL-F-PN  EKSNGRFAEFLKLIVGNQADFKKHF--ELEEK-A---PLQ--FSKDTYEEELEV  277
WP_002287255    212 LTDK-ISKSAKKDRVLKL-F-PN  EKSNGRFAEFLKLIVGNQADFKKHF--ELEEK-A---PLQ--FSKDTYEEELEV  277
WP_002288990    212 LTDK-ISKSAKKDRVLKL-F-PN  EKSNGRFAEFLKLIVGNQADFKKHF--ELEEK-A---PLQ--FSKDTYEEELEV  277
WP_002289641    212 LTDK-ISKSAKKDRVLKL-F-PN  EKSNGCFAEFLKLIVGNQADFKKHF--ELEEK-A---PLQ--FSKDTYEEELEV  277
WP_002290427    212 LTDK-ISKSAKKDRVLKL-F-PN  EKSNGRFAEFLKLIVGNQADFKKHF--ELEEK-A---PLQ--FSKDIYEEELEV  277
WP_002295753    212 LTDK-ISKSAKKDRVLKL-F-PN  EKSNGRFAEFLKLIVGNQADFKKHF--ELEEK-A---PLQ--FSKDTYEEELEV  277
WP_002296423    212 LTDK-ISKSAKKDRVLKL-F-PN  EKSNGRFAEFLKLIVGNQADFKKHF--ELEEK-A---KLQ--FSKDIYEEELEV  277
WP_002304487    212 LTEK-VSKSRRLENLVEC-Y-PT  EKKNTLFGNLIALSLGLQPNFKTNF--QLSED-A---KLQ--FSKDTYEDLEG   277
WP_002305844    212 LTDK-ISKSAKKDRVLKL-F-PN  EKSNGRFAEFLKLIVGNQADFKKHF--ELEEK-A---PLQ--FSKDTYEEELEV  277
WP_002307203    212 LTDK-ISKSAKKDRVLKL-F-PN  EKSNGRFAEFLKLIVGNQADFKKHF--ELEEK-A---PLQ--LSKDTYEEELEV  277
WP_002310390    212 LTDK-ISKSAKKDRVLKL-F-PN  EKSNGRFAEFLKLIVGNQADFKKHF--ELEEK-A---PLQ--FSKDTYEEELEV  277
WP_002352408    212 LTDK-ISKSAKKDRVLKL-F-PN  EKSNGRFAEFLKLIVGNQADFKKHF--ELEEK-A---PLQ--FSKDIYEEELEV  277
WP_012997688    212 LTDK-ISKSAKKDRVLKL-F-PN  EKSNGRFAEFLKLIVGNQADFKKHF--ELEEK-A---PLQ--FSKDTYEEELEV  277
WP_014677909    212 LTDK-ISKSRRLEKLINN-Y-PK  EKKNTLFGNLIALSLGLQPNFKTNF--KLSED-A---KLQ--FSKDTYEEDLEE  277
WP_019312892    212 LTDK-ISKSAKKDRVLKL-F-PN  EKSNGRFAEFLKLIVGNQADFKKHF--ELEEK-A---PLQ--FSKDTYEEDLEE  277
WP_019313659    212 LTDK-ISKSAKKDRVLKL-F-PN  EKSNGRFAEFLIIGNQADFKKHF---ELEEK-A---PLQ--FSKDTYEEELEV   277
WP_019314093    212 LTEK-ISKSRRLEKLINN-Y-PK  EKSNGRFAEFLKLIVGNQADFKKHF--ELEEK-A---PLQ--LSKDTYEEELEV  277
WP_019315370    212 LTDK-ISKSAKKDRVLKL-F-PN  EKSNGRFAEFLKLIVGNQADFKKHF--ELEEK-A---PLQ--FSKDTYEEELEV  277
WP_019803776    212 LTDK-ISKSAKKDRVLKL-F-PN  EKSNGRFAEFLKLIVGNQADFKKHF--ELEEK-V---PLQ--FSKDTYEEELEV  277
WP_019805234    212 LTDK-ISKSAKKDRVLKL-F-PN  EKSNGRFAEFLKLIVGNQADFKKHF--ELEEK-A---PLQ--FSKDTYEEELEV  277
WP_024783594    212 LTDK-ISKSAKKDRVLKL-F-PN  EKSNGRFAEFLKLIVGNQADFKKHF--ELEEK-A---PLQ--FSKDTYEEELEE  277
WP_024784288    212 LTDK-ISKSRRLEKLINN-Y-PK  EKKNTLFGNLIALSLGLQPNFKTNF--KLSED-A---KLQ--FSKDTYEEDLEE  277
WP_024784666    212 LTDK-ISKSAKKDRVLKL-F-PN  EKSNGRFAEFLKLIVGNQADFKKHF--ELEEK-A---PLQ--FSKDTYEEDLEE  277
WP_024784894    212 LTDK-ISKSAKKDRVLKL-F-PN  EKSNGRFAEFLKLIVGNQADFKKHF--ELEEK-A---PLQ--FSKDTYEEELEV  277
WP_024786433    212 LTEK-ISKSRRLEKLINN-Y-PK  EKKNTLFGNLIALSLGLQPNFKTNF--KLSED-A---KLQ--FSKDTYEEDLEE  277
WP_049473442    212 LTDK-ISKSAKKDRVLKL-F-PN  EKSNGRFAEFLKLIVGNQADFKKHF--ELEEK-A---PLQ--FSKDTYEEDLEE  277
WP_049474547    212 LTDK-ISKSAKKDRVLKL-F-PN  EKSNGRFAEFLKLIVGNQADFKKHF--ELEEK-A---PLQ--FSKDTYEEELEV  277
EMC03581        205 LTDK-ISKSAKKDRVLKL-F-PN  EKSNGRFAEFLKLIVGNQADFKKHF--ELEEK-A---PLQ--FSKDTYEEELEV  270
WP_000428612    213 FTDK-ISKSAKRERVLKL-F-PD  EKSTGLFSEFLKLIVGNQADFKKHF--DLGEK-A---PLQ--FSKDTYDEDLEN  278
WP_000428613    213 FTDK-ISKSAKRERVLKL-F-PD  EKSTGLFSEFLKLIVGNQADFKKHF--DLGEK-A---PLQ--FSKDTYDEDLEN  278
WP_049523028    212 FTDK-ISKSAKRERVLKL-F-PD  EKSTGLFSEFLKLIVGNQADFKKHF--ELSED-A---PLQ--FSKDTYEEDLES  277
WP_003107102    181 LTEK-MSKSRRLENLIAK-I-PD  QKKNTLFGNLIALSLGLTPNFKANF--KLQ---ISKESPEEDLDN              246
WP_054279288    214 LTEK-ISKTRRLENLISN-I-PG  QKKNGLFGNLIALSLGLTPNFKSHF--NLPED-A---KLQ--LAKDTDEELNN    279
WP_049531101    213 FSDK-ISKSTKRERVLKL-F-PD  QKSTGLFSEFLKLIVGNQADFKKHF--DLEEK-A---PLQ--FSKDTYDEDLEN   278
WP_049538452    213 FTDK-ISKSAKRERVLKL-F-PD  EKSTGLFSEFLKLIVGNQADFKKHF--DLGEK-A---PLQ--FSKDTYDEDLEN  278
WP_049549711    214 LTAK-TSKSKRLESLISE-F-PG  QKKNGLFGNLLALALGLRPNEKSNF--GLSED-A---KLQ--ITKDTYEEELDN   279
WP_007896501    166 LTAK-TSKSKRLESLISE-F-PG  QKKNGLFGNLLALALGLRPNEKSNF--GLSED-A---KLQ--ITKDTYEEELDN   231
EFR44625        212 FTDK-ISKSAKRERVLKL-F-PD  EKSTGLFSEFLKLIVGNQADFKKHF--DLEEK-A---PLQ--FSKDTYEEELDN   277
WP_002897477    212 FTDK-ISKSAKRERVLKL-F-SD  EKSTGLFSEFLKLIVGNQADFKKHF--DLEEK-A---PLQ--FSKDTYEDLEN    277
WP_002906454    213 FTDK-ISKSAKRERVLKL-F-PD  EKSTGLFSEFLKLIVGNQADFKKHF--DLEEK-A---PLQ--FSRDTYDEDLEN   278
WP_009729476
```

```
CQR24647         ITAK-ISKSRKVEAVLEQ-F-PD  QKKINSFFGNMVSLVFGLMPNEKSNF--ELDED-A---KLQ--FSRDSYDEDLEN   277
WP_000066813     FTDK-ISKSTKRERVLKL-F-PD  EKSTGLFSEFLKLIVGNQADFKKHF--DLEEK-A---PLQ--FSKDTYDEDLEN   278
WP_009754323     FTGK-ISKSVKREHVLKL-F-PD  EKSTGLFSEFLKLIVGNQADFKKHF--DLEEK-A---SLQ--FSKDTYDEDLEN   278
WP_044674937     LVEK-VSKSRRLENILHY-F-PN  EKKNGLFGNFLALALGLQPNEKTNF--ELAED-A---KIQ--FSKETYEEDLEE   277
WP_044676715     LVEK-VSKSRRLENILHY-F-PN  EKKNGLFGNFLTLALGLQPNEKTNF--ELAED-A---KIQ--FSKETYEEDLEE   277
WP_044680361     LVEK-VSKSRRLENILHY-F-PN  EKKNGLFGNFLALALGLQPNEKTNF--ELAED-A---KIQ--FSKETYEEDLEE   277
WP_044681799     LVEK-VSKSRRLENILHY-F-PN  EKKNGLFGNFLALALGLQPNEKTNF--ELAED-A---KIQ--FSKETYEEDLEE   277
WP_049533112     LTEK-VSKSRRLENLIAH-Y-PA  EKKNTLFGNLIALSLGLQPNEKTNF--QLSED-A---KIQ--FSKETYEEDLEG   277
WP_029090905     LLDRmMNRSSKVKFLIEL---TG  KQDKPLLKELFNLIVGLLKAKPASIFe---QENlAtivETM-nMSTEQVQLDLLT   243
WP_006506696     LKKP-LSKKAKVDEVMTL-IaPE  KDYKSAFKELVTGlAGNKMNVTKMIcEPIKq-Gds-BIKlKFSDSNYDDQFSE     283
AIT42264         LSAR-LSKSRRLENLIAQ-L-PG  EKKNGLFGNLIALSLGLTPNEKSNF--DLAED-A---KLQ--LSKDTYDDDLDN   277
WP_034440723     FKQD-ISRSKKLDQAIAL-L-PG  -KRQSLFGIFLTLIVGNKANFQKIF--NLEDD----iKLD--IKEEDYDENLEE   277
AKQ21048         LSAR-LSKSRRLENLIAQ-L-PG  EKKNGLFGNLIALSLGLTPNEKSNF--DLAED-A---KLQ--LSKDTYDDDLDN   277
WP_004636532     LSSK-QSRKHEQIMAL-F-PN    ENKLGNFGRFMMLIVGNTSNFKPVF--DLDDE-Y---KLK--LSDETYEEDLDT   276
WP_002364836     LTEK-ASRTKKSEKVLQQ-F-PQ  EKANGLFGQFLKLMVGNKADFKKVF--GLEEE-A---KI---tYASESYEEDLEG   283
WP_016631044     LTEK-ASRTKKSEKVLQQ-F-PQ  EKANGLFGQFLKLMVGNKADFKKVF--GLEEE-A---KI---tYASESYEEDLEG   234
EMS75795         ---------------------     ----------------MDEE-A---KIQ--LSKESYEEDLES                     20
WP_002373311     LTEK-ASRTKKSEKVLQQ-F-PQ  EKANGLFGQFLKLMVGNKADFKKVF--GLEEE-A---KI---tYASESYEEDLEG   283
WP_002378009     LTEK-ASRTKKSEKVLQQ-F-PQ  EKANGLFGQFLKLMVGNKADFKKVF--GLEEE-A---KI---tYASESYEEDLEG   283
WP_002407324     LTEK-ASRTKKSEKVLQQ-F-PQ  EKANGLFGQFLKLMVGNKADFKKVF--GLEEE-A---KI---tYASESYEEDLEG   283
WP_002413717     LTEK-ASRTKKSEKVLQQ-F-PQ  EKANGLFGQFLKLMVGNKADFKKVF--GLEEE-A---KIKiYASESYEEDLEG    285
WP_010775580     LTEK-ASRTKKSEKVLQQ-F-PQ  EKANGLFGQFLKLMVGNKADFKKVF--GLEEE-A---KI---tYASESYEEDLEG   283
WP_010818269     LTEK-ASRTKKSEKVLQQ-F-PQ  EKANGLFGQFLKLMVGNKADFKKVF--GLEEE-A---KI---tYASESYEEDLEG   283
WP_010824395     LTEK-ASRTKKSEKVLQQ-F-PQ  EKANGLFGQFLKLMVGNKADFKKVF--GLEEE-A---KI---tYASESYEEDLEG   283
WP_016622645     LTEK-ASRTKKSEKVLQQ-F-PQ  EKANGLFGQFLKLMVGNKADFKKVF--GLEEE-A---KI---tYASESYEEDLEG   283
WP_033624816     LTEK-ASRTKKSEKVLQQ-F-PQ  EKANGLFGQFLKLMVGNKADFKKVF--GLEEE-A---KI---tYASESYEEDLEG   283
WP_033625576     LTEK-ASRTKKSEKVLQQ-F-PQ  EKANGLFGQFLKLMVGNKADFKKVF--GLEEE-A---KI---tYASESYEEDLEG   283
WP_033789179     LTEK-ASRTKKAETLLKY-F-PH  EKANGLFGQFLKLMVGNKADFKKVF--GLEEE-A---KLQ--FSKETYEEDLEG   283
WP_002310644     FTEK-MSKTKKAETLLKY-F-PH  EKSNGYLSQFIKLMVGNQGNFKNVF--GL-EE-A---KLQ--FSKETYEEDLEE   281
WP_002122694     FTEK-MSKTKKAETLLKY-F-PH  EKSNGYLSQFIKLMVGNQGNFKNVF--GL--EEeA---KLQ--FSKETYEEDLES   282
WP_002314015     FTEK-MSKTKKAETLLKY-F-PH  EKSNGYLSQFIKLMVGNQGNFKNVF--GL--EEeA---KLQ--FSKETYEEDLES   282
WP_002320716     FTEK-MSKTKKAETLLKY-F-PH  EKSNGYLSQFIKLMVGNQGNFKNVF--GL--EEeA---KLQ--FSKETYEEDLES   282
WP_002330729     FTEK-MSKTKKAETLLKY-F-PH  EKSNGYLSQFIKLMVGNQGNFKNVF--GL--EEA----KLQ--FSKETYEEDLES   281
WP_002335161     FTEK-MSKTKKAETLLKY-F-PH  EKSNGYLSQFIKLMVGNQGNFKNVF--GL--EEeA---KLQ--FSKETYEEDLES   282
WP_002345439     FTEK-MSKTKKAETLLKY-F-PH  EKSNGYLSQFIKLMVGNQGNFKNVF--GL--EEeA---KLQ--FSKETYEEDLES   282
WP_034867970     LTDK-LSKTKKVEEILKY-Y-PT  EKINSFFAQCLKLIVGNQANFKRIF--DLEAE-V---KLQ--FSKEEYEEDLES   275
WP_047937432     FTEK-MSKTKKAETLLKY-Y-PT  EKSNGYLSQFIKLMVGNQGNFKNVF--GL--EEeA---KLQ--FSKETYEEDLEE   282
WP_010720994     LTDK-LSKTKKVEEILKY-Y-PT  EKINSFFAQCLKLIVGNQANFKRIF--DLEAE-V---KLQ--FSKEEYEEDLES   275
WP_010733004     LTDK-LSKTKKVEEILKY-Y-PT  EKINSFFAQCLKLIVGNQANFKRIF--DLEAE-V---KLQ--FSKEEYEEDLES   275
WP_048604708     LTDK-LSKTKKVEEILKY-Y-PT  EKINSFFAQCLKLIVGNQANFKRIF--DLEAE-V---KLQ--FSKEEYDESLEA   274
WP_010750235     LTDK-LSKKVKEKILQY-Y-PK   EKTTGCLAQFLKLIVGNQGNFKQAF--HLDEE-V---KIQ--ISKEYEEDLEK    275
WP_072090003     LTQQ-LSKSERADNVLKL-F-PH  EKTGIFAQFLKLIVGNQGNFKNVF--GL--EED----qKLQ--LSTDDYEENIEN   280
AII16583         LSAR-LSKSRRLENLIAQ-L-PG  EKKNGLFGNLIALSLGLTPNEKSNF--DLAED-A---KLQ--LSKDTYDDDLDN   316
WP_023519017     LTER-LSKAKRVEKVLAY-Y-PS  EKSTGNFAQFLKLMVGNQGNFKKTF--DLEEE-M---KLN--PTRDCYEEDLNE   275
WP_010770040     FSEK-VSRARKVEAILSV-Y-SE  EKSTGTLAQFLKLMVGNQGRFKKTF--DLEED-G---IIQ--IPKEEYEEELET   278
WP_048604708     FADK-VSRAKKAEGVLAL-F-PD  EKRNGTFDQFLKMIVGNQNFKKTF--ELDEE-V---KLQ--FSKEEYDESLEA    274
WP_010750235     LTDK-LSKSKKVKEKILQY-Y-PK EKTTGCLAQFLKLIVGNQGNFKQAF--HLDEE-V---KIQ--ISKEYEEDLEK     275
AII16583         LSAR-LSKSRRLENLIAQ-L-PG  EKKNGLFGNLIALSLGLTPNEKSNF--DLAED-A---KLQ--LSKDTYDDDLDN    316
WP_029073316     LKEP-LSKKHADKAFAL-FdTT   KDNKAAYKELCAALAGNKFNVTKMLkeAELHD-EdekDISfkFSDATFDDAFVE   289
WP_031589969     LKEP-LSKKHAEKAFAL-FdTT   KDNKAAYKELCAALAGNKFNVTKMLkeAELHD-EdekDISfkFSDATFDDAFVE   289
KDA45870         FKDNfFSKTKKSELLKL---SG    -KKNqLAHqLFKMMVGNMGSFKKVL--GTDEE----hKLS--FGKDTYEDDLND    275
WP_039099354     LLDNhqSASNRQRQALLLIytPS   KQNKAIATELLKAILGLKAKFNVLT--GlEAEGVktwTLT--FNAENFDEEMVK   285
AKP02966         LIGR-GNATQKSSNILNN-F--T  KETKKLLKEVINLILGNVAHLNTIFktSLTKDeE---KLS--FSGKDIESKLDD   278
WP_010991369     LVEK-VTRKEKLERILKL-Y-PG  EKSAGMFAQFISLIVGSKGNFQKPF--DLIEK-S----DIE--CAKDSYEEDLES   283
WP_033838504     LVEK-VTRKEKLERILKL-Y-PG  EKSAGMFAQFISLIVGSKGNFQKPF--DLIEK-S----DIE--CAKDSYEEDLES   283
EHN60060         LVEK-VTRKEKLERILKL-Y-PG  EKSAGMFAQFISLIVGSKGNFQKPF--DLIEK-S----DIE--CAKDSYEEDLES   286
```

```
                      -continued

EFR89594           1 ----------LKL-Y-PG EKSTGMPAQFISLIVGSKGNFQKPF--DLIEK-S---DIE-CAKDSYEEDLES         52
WP_038409211     218 LSEK-LTRREKLDKILKL-Y-TG EKSTGMFARFINLIIGSKGDFKKVF--DLDEK-A---EIE-CAKDTYEEDLEA        283
EFR95520             ---------------------- ------------------------------------------------------        283
WP_003723650     218 LAGK-FTRREKFPERILQL-Y-PG EKSTGMFAQFISLIVGSKGNFQKVF--DLIEK-T---DIE-CAKDSYEEDLET        283
WP_003727705     218 LAGK-FTRREKFPERILRL-Y-PG EKSTGMFAQFISLIVGNKGNFQKVF--NLVEK-T---DIE-CAKDSYEEDLEA        283
WP_003730785     218 LAGK-FTRREKFPERLRL-Y-PG EKSTGMFAQFISLIVGNKGNFQKVF--NLVEK-T---DIE-CAKDSYEEDLEA        283
WP_003733029     218 LAEK-FTREKDKLDKILSL-Y-PG EKTTGVFAQFVNIIVGSTGKEKKHF--NLHEK-K---DIN-CAEDTYDTDLES        283
WP_003739838     218 LAGK-FTRKDKLDKILSL-Y-PG EKSTGMFAQFISLIVGSKGNFQKVF--DLVEK-T---DIE-CAKDSYEEDLEA        283
WP_014601172     218 LAGK-FTRKEKLERILQL-Y-PG EKSTGMFAQFISLIVGSKGNFQKVF--DLIEK-T---DIE-CAEDTYDTDLES        283
WP_023548323     218 LAGK-FTRREKFPERILQL-Y-PG EKSTGMFAQFISLIVGSKGNFQKVF--DLIEK-T---DIE-CAKDSYEEDLET        283
WP_031665337     218 LAGK-FTRREKFPERILQL-Y-PG EKSTGMFAQFISLIVGSKGNFQKVF--DLIEK-T---DIE-CAKDSYEEDLET        283
WP_031669209     218 LAEK-FTRKDKLDKILSL-Y-PG EKTTGVFAQFVNIIVGSTGKEKKHF--NLHEK-K---DIN-CAEDTYDTDLES        283
WP_033920898     218 LARK-FTRREKFPERILQL-Y-PG EKSTGMFAQFISLIVGSKGNFQKVF--DLIEK-T---DIE-CAKDSYEEDLET        283
AKI42028         221 LAGK-FTRREKFPERILQL-Y-PG EKSTGMFAQFISLIVGSKGNFQKVF--DLIEK-T---DIE-CAKDSYEEDLEA        286
AKI50529         221 LARK-FTRREKFPERILQL-Y-PG EKSTGMFAQFISLIVGSKGNFQKVF--DLIEK-T---DIE-CAKDSYEEDLET        286
EFR83390             ---------------------- ------------------------------------------------------        
WP_046323366     218 FSEK-LTKREKLDKILNL-Y-PN EKSTDLFAQFISLLIGSKGNFKKFF--NLTEK-T---DIE-CAKDSYEEDLEV        283
AKE81011         228 LSAR-LSKSRRLENLIAQ-L-PG EKKNGLFGNLIALSLGLTPNEKSNF--DLAED-A---KLQ-LSKDTYDDDLDN        293
CUO82355         215 LKKP-LSKKAKVDEVMAL-IsPE KEEKSAYKELVTGIAGNKMNVTKMIcESIKQ-Gds-EIKlkFSDSNYDDQFSE        287
WP_031628887     216 LSKI-YQRSKKADDLLKI-MnPT KEEKAAYKEFTKALVGLKENISKMI1aQEVKK-Gdt-DIV1eFSNANYDSTIDE        288
AGZ01981         245 LSAR-LSKSRRLENLIAQ-L-PG EKKNGLFGNLIALSLGLTPNFKSNF--DLAED-A---KLQ-LSKDTYDDDLDN        310
AKA60242         212 LSAR-LSKSRRLENLIAQ-L-PG EKKNGLFGNLIALSLGLTPNFKSNF--DLAED-A---KLQ-LSKDTYDDDLDN        277
AKS40380         212 LSAR-LSKSRRLENLIAQ-L-PG EKKNGLFGNLIALSLGLTPNFKSNF--DLAED-A---KLQ-LSKDTYDDDLDN        277
4UN5_B           216 LSAR-LSKSRRLENLIAQ-L-PG EKKNGLFGNLIALSLGLTPNFKSNF--DLAED-A---KLQ-LSKDTYDDDLDN        281

WP_010922251     278 LLAQIGDQYADLFLAA[N]NLSDAILLSGILTVDDNSTKAPLSASMIKRYDEHHQDLTLLKALVRQQ-LPEKYKEIFFDQSK        356

WP_039695303     279 LLGKIGDDYADLFTSAKNLYDAILLSGILTVDDNSTKAPLSASMIKRYVEHHEDLEKLKEFIKAN-KSELYHDIFKDKNK        357
WP_045635197     278 LLGQIGDDFTDLFVSAKKLYDAILLSGILTVDPSTKAPLSASMIERYENHQNDLAALKQFIKNN-LPEKYDEVFSDQSK       356
5AXW_A           158 ---------------------- --------------------------------LERLKDG--------EVR-------       168
WP_009880683       1 ---------------------- --------LSASMIKRYDEHHQDLTLLKALVRQQ-LPEKYKEIFFDQSK             40
WP_010922251     278 LLAQIGDQYADLFLAAKNLSDAILLSDIILRVNTEITKAPLSASMIKRYDEHHQDLTLLKALVRQQ-LPEKYKEIFFDQSK   356
WP_010544416     278 LLAQIGDQYADLFLAAKNLSDAILLSDATLLSGILRVNSEITKAPLSASMIKRYDEHHQDLTLLKALVRQQ-LPEKYKEIFFDQSK 356
WP_011284745     278 LLAQIGDQYADLFLAAKNLSDAILLSDIILRLNSEITKAPLSASMIKRYDEHHQDLTLLKALVRQQ-LPEKYKEIFFDQSK   356
WP_011285506     278 LLAQIGDQYADLFLAAKNLSDAILLSDIILRVNTEITKAPLSASMIKRYDEHHQDLTLLKALVRQQ-LPEKYKEIFFDQSK   356
WP_011527619     278 LLAQIGDQYADLFLAAKNLSDAILLSDIILRLNSEITKAPLSASMIKRYDEHHQDLTLLKALVRQQ-LPEKYKEIFFDQSK   356
WP_012560673     278 LLAQIGDQYADLFLAAKNLSDAILLSDIILRVNTEITKAPLSASMIKRYDEHHQDLTLLKALVRQQ-LPEKYKEIFFDQSK   356
WP_014407541     278 LLAQIGDQYADLFLAAKNLSDAILLSDIILRVNSEITKAPLSASMIKRYDEHHQDLTLLKALVRQQ-LPEKYKEIFFDQSK   356
WP_020905136     278 LLAQIGDQYADLFLAAKNLSDAILLSDIILRLNSEITKAPLSASMIKRYDEHHQDLTLLKALVRQQ-LPEKYKEIFFDQSK   356
WP_023080005     278 LLAQIGDQYADLFLAAKNLSDAILLSDIILRVNSEITKAPLSASMIKRYDEHHQDLTLLKALVRQQ-LPEKYKEIFFDQSK   356
WP_023610282     278 LLAQIGDQYADLFLAAKNLSDAILLSDIILRVNSEITKAPLSASMIKRYDEHHQDLTLLKALVRQQ-LPEKYKEIFFDQSK   356
WP_030125963     278 LLAQIGDQYADLFLAAKNLSDAILLSDIILRVNTETKASLSASMIKRYDEHHQDLTLLKALVRQQ-LPEKYKEIFFDQSK    356
WP_030126706     278 LLAQIGDQYADLFLAAKNLSDAILLSDATLLSGILRVNSEITKAPLSASMIKRYDEHHQDLTLLKALVRQQ-LPEKYKEIFFDQSK 356
WP_031488318     278 LLAQIGDQYADLFLAAKNLSDAILLSDIILRVNTEITKAPLSASMIKRYDEHHQDLTLLKALVRQQ-LPEKYKEIFFDQSK   356
WP_032460140     278 LLAQIGDQYADLFLAAKNLSDAILLSDIILRVNSEITKAPLSASMIKRYDEHHQDLTLLKALVRQQ-LPEKYKEIFFDQSK   356
WP_032461047     278 LLAQIGDQYADLFLAAKNLSDAILLSDIILRVNSEITKAPLSASMIKRYDEHHQDLTLLKALVRQQ-LPEKYKEIFFDQSK   356
WP_032462016     278 LLAQIGDQYADLFLAAKNLSDAILLSDIILRVNSEITKAPLSASMIKRYDEHHQDLTLLKALVRQQ-LPEKYKEIFFDQSK   356
WP_032462936     278 LLAQIGDQYADLFLAAKNLSDAILLSDIILRVNSEITKAPLSASMIKRYDEHHQDLTLLKALVRQQ-LPEKYKEIFFDQSK   356
WP_032464890     278 LLAQIGDQYADLFLAAKNLSDAILLSDIILRVNSEITKAPLSASMIKRYDEHHQDLTLLKALVRQQ-LPEKYKEIFFDQSK   356
WP_033888930     103 LLAQIGDQYADLFLAAKNLSDAILLSDATLLSGILRVNSEITKAPLSASMIKRYDEHHQDLTLLKALVRQQ-LPEKYKEIFFDQSK 181
WP_038431314     278 LLAQIGDQYADLFLAAKNLSDAILLSDIILRVNSEITKAPLSASMIKRYDEHHQDLTLLKALVRQQ-LPEKYKEIFFDQSK   356
WP_038432938     278 LLAQIGDQYADLFLAAKNLSDAILLSDIILRVNSEITKAPLSASMIKRYDEHHQDLTLLKALVRQQ-LPEKYKEIFFDQSK   356
WP_038434062     278 LLAQIGDQYADLFLAAKNLSDAILLSDIILRVNSEITKAPLSASMIKRYDEHHQDLTLLKALVRQQ-LPEKYKEIFFDQSK   356
BAQ51233         189 LLAQIGDQYADLFLAAKNLSDAILLSDIILRVNTEITKAPLSASMIKRYDEHHQDLTLLKALVRQQ-LPEKYKEIFFDQSK   267
```

```
KGE60162                                                                                                                                         
KGE60856                                                                                                                                         
WP_002989955    278    LLAQIGDQYADLFLAAKNLSDAILLSDILRLNSEITKAPLSASMIKRYDEHHQDLTLLKALVRQQ-LPEKYKEIFFDQSK    356
WP_003030002    278    LLGEIGDEYADLFASAKNLYDAILLSGILTVDDNSTKAPLSASMVKRYEHQKDLKKLKDFIKVN-APDQYNAIFKDKNK    356
WP_003065552    281    LLGKILGDDYADLFTSAKNLYDAILLSGILIVDDNSTKAPLSASMIKRYVEHQEDLEKLKEFIKAN-KSELYHDIFKDKNK   359
WP_001040076    279    LLGQIGDEFADLFSAAKKLYDSVLLSGILTVTDLSTKAPLSASMIQRYDEHREDLKQLKQFVKAS-LPEKYQEIVADSSK    357
WP_001040078    279    LLGQIGDEFADLFSAAKKLYDSVLLSGILTVIDLSTKAPLSASMIQRYDEHREDLKQLKQFVKAS-LPEKYQEIFADSSK    357
WP_001040080    279    LLGQIGDEFADLFSAAKKLYDSVLLSGILTVIDLSTKAPLSASMIQRYDEHREDLKQLKQFVKAS-LPEKYQEIFADSSK    357
WP_001040081    279    LLGQIGDEFADLFSAAKKLYDSVLLSGILTVIDLSTKAPLSASMIQRYDEHREDLKQLKQFVKAS-LPEKYQEIFADSSK    357
WP_001040083    279    LLGQIGDEFADLFSAAKKLYDSVLLSGILTVIDLSTKAPLSASMIQRYDEHREDLKQLKQFVKAS-LPEKYQEIFADSSK    357
WP_001040085    279    LLGQIGDEFADLFSAAKKLYDSVLLSGILTVIDLSTKAPLSASMIQRYDEHREDLKQLKQFVKAS-LPEKYQEIFADSSK    357
WP_001040087    279    LLGQIGDEFADLFSAAKKLYDSVLLSGILTVIDLSTKAPLSASMIQRYDEHREDLKQLKQFVKAS-LPEKYQEIFADSSK    357
WP_001040088    279    LLGQIGDEFADLFSAAKKLYDSVLLSGILTVIDLSTKAPLSASMIQRYDEHREDLKQLKQFVKAS-LPEKYQEIFADSSK    357
WP_001040089    279    LLGQIGDEFADLFSAAKKLYDSVLLSGILTVIDLSTKAPLSASMIQRYDEHREDLKQLKQFVKAS-LPEKYQEIFADSSK    357
WP_001040090    279    LLRQIGDEFADLFSAAKKLYDSVLLSGILTVTDLSTKAPLSASMIQRYDEHREDLKQLKQFVKAS-LPEKYQEIFADSSK    357
WP_001040091    279    LLGQIGDEFADLFSAAKKLYDSVLLSGILTVIDLSTKAPLSASMIQRYDEHREDLKQLKQFVKAS-LPEKYQEIFADSSK    357
WP_001040092    279    LLGQIGDEFADLFSAAKKLYDSVLLSGILTVIDLSTKAPLSAYMIQRYDEHREDLKQLKQFVKAS-LPEKYQEIFADSSK    357
WP_001040094    279    LLGQIGDEFADLFSAAKKLYDSVLLSGILTVIDLSTKAPLSASMIQHYDEHREDLKQLKQFVKAS-LPEKYQEIFADSSK    357
WP_001040095    279    LLGQIGDEFADLFSAAKKLYDSVLLSGILTVIDLSTKAPLSASMIQRYDEHREDLKQLKQFVKAS-LPEKYQEIFADSSK    357
WP_001040096    279    LLGQIGDEFADLFSAAKKLYDSVLLSGILTVIDLSTKAPLSASMIQRYDEHREDLKQLKQFVKAS-LPEKYQEIFADSSK    357
WP_001040097    279    LLGQIGDEFADLFSAAKKLYDSVLLSGILTVIDLSTKAPLSASMIQRYDEHREDLKQLKQFVKAS-LPEKYQEIFADSSK    357
WP_001040098    279    LLGQIGDEFADLFSAAKKLYDSVLLSGILTVIDLSTKAPLSASMIQRYDEHREDLKQLKQFVKAS-LPEKYQEIFADSSK    357
WP_001040099    279    LLGQIGDEFADLFSAAKKLYDSVLLSGILTVIDLSTKAPLSASMIQRYDEHREDLKQLKQFVKAS-LPEKYQEIFADSSK    357
WP_001040100    279    LLGQIGDEFADLFSAAKKLYDSVLLSGILTVIDLSTKAPLSASMIQRYDEHREDLKQLKQFVKAS-LPEKYQEIFADSSK    357
WP_001040104    279    LLGQIGDEFADLFSAAKKLYDSVLLSGILTVIDLSTKAPLSASMIQRYDEHREDLKQLKQFVKAS-LPEKYQEIFADSSK    357
WP_001040105    279    LLGQIGDEFADLFSAAKKLYDSVLLSGILTVIDLSTKAPLSASMIQRYDEHREDLKQLKQFVKAS-LPEKYQEIFADSSK    357
WP_001040106    279    LLGQIGDEFADLFSVAKKLYDSVLLSGILTVIDLSTKAPLSASMIQRYDEHREDLKQLKQFVKAS-LPEKYQEIFTDSSK    357
WP_001040107    279    LLGQIGDEFADLFSVAKKLYDSVLLSGILTVIDLSTKAPLSASMIQRYDEHREDLKQLKQFVKAS-LPEKYQEIFTDSSK    357
WP_001040108    279    LLGQIGDEFADLFSAAKKLYDSVLLSGILTVIDLSTKAPLSASMIQRYDEHREDLKQLKQFVKAS-LPEKYQEIFTDSSK    357
WP_001040109    279    LLGQIGDEFADLFSAAKKLYDSVLLSGILTVIDLSTKAPLSASMIQRYDEHREDLKQLKQFVKAS-LPEKYQEIFTDSSK    357
WP_001040110    279    LLGQIGDEFADLFSVAKKLYDSVLLSGILTVIDLSTKAPLSASMIQRYDEHREDLKQLKQFVKAS-LPEKYQEIFTDSSK    357
WP_015058523    279    LLGQIGDEFADLFSAAKKLYDSVLLSGILTVIDLSTKAPLSASMIQRYDEHREDLKQLKQFVKAS-LPEKYQEIFADSSK    357
WP_017643650    279    LLGQIGDEFADLFSAAKKLYDSVLLSGILTVIDLSTKAPLSASMIQRYDEHREDLKQLKQFVKAS-LPEKYQEIFADSSK    357
WP_017647151    279    LLGQIGDEFADLFSAAKKLYDSVLLSGILTVIDLSTKAPLSASMIQRYDEHREDLKQLKQFVKAS-LPEKYQEIFTDSSK    357
WP_017648376    279    LLGQIGDEFADLFSAAKKLYDSVLLSGILTVIDLSTKAPLSASMIQRYDEHREDLKQLKQFVKAS-LPEKYQEIFTDSSK    357
WP_017649527    279    LLGQIGDEFADLFSAAKKLYDSVLLSGILTVIDLSTKAPLSASMIQRYDEHREDLKQLKQFVKAS-LPEKYQEIFTDSSK    357
WP_017771611    279    LLGQIGDEFADLFSAAKKLYDSVLLSGILTVTALSTKAPLSASMIQRYDEHREDLKQLKQFVKAS-LPEKYQEIFTDSSK    357
WP_017771984    279    LLGQIGDEFADLFSAAKKLYDSVLLSGILTVIDLSTKAPLSASMIQRYDEHREDLKQLKQFVKAS-LPEKYQEIFADSSK    357
CFQ25032        279    LLGQIGDEFADLFSAAKKLYDSVLLSGILTVIDLSTKAPLSASMIQRYDEHREDLKQLKQFVKAS-LPEKYQEIFADSSK    357
CFV16040        279    LLGQIGDEFADLFSAAKKLYDSVLLSGILTVIDLSTKAPLSASMIQRYDEHREDLKQLKQFVKAS-LPEKYQEIFADSSK    357
KLJ37842        279    LLGQIGDEFADLFSAAKKLYDSVLLSGILTVIDLSTKAPLSASMIQRYDEHREDLKQLKQFVKAS-LPEKYQEIFADSSK    357
KLJ72361        279    LLGQIGDEFADLFSAAKKLYDSVLLSGILTVIDLSTKAPLSASMIQRYDEHREDLKQLKQFVKAS-LPEKYQEIFADSSK    357
KLL20707        279    LLGQIGDEFADLFSAAKKLYDSVLLSGILTVIDLSTKAPLSASMIQRYDEHREDLKQLKQFVKAS-LPEKYQEIFADSSK    357
KLL42645        279    LLGQIGDEFADLFSAAKKLYDSVLLSGILTVIDLSTKAPLSASMIQRYDEHREDLKQLKQFVKAS-LPEKYQEIFTDSSK    357
WP_047207273    279    LLGQIGDEFADLFSAAKKLYDSVLLSGILTVIDLSTKAPLSASMIQRYDEHREDLKQLKQFVKAS-LPEKYQEIFTDSSK    357
WP_047209694    279    LLGQIGDEFADLFSAAKKLYDSVLLSGILTVIDLSTKAPLSASMIQRYDEHREDLKQLKQFVKAS-LPEKYQEIFADSSK    357
WP_050198062    279    LLGQIGDEFADLFSAAKKLYDSVLLSGILTVIDLSTKAPLSASMIQRYDEHREDLKQLKQFVKAS-LPEKYQEIFADSSK    357
WP_050201642    279    LLGQIGDEFADLFSAAKKLYDSVLLSGILTVIDLSTKASLSDSMIQRYDEHREDLKQLKQFVKAS-LPEKYQEIFADSSK    357
WP_050204027    279    LLGQIGDEFADLFSVAKKLYDSVLLSGILTVTDLSTKAPLSASMIQRYDEHREDLKQLKQFVKAS-LPEKYQEIFTDSSK    357
WP_050881965    279    LLGQIGDEFADLFSAAKKLYDSVLLSGILTVIDLSTKAPLSASMIQRYDEHREDLKQLKQFVKAS-LPEKYQEIFADSSK    357
WP_050886065    279    LLGQIGDEFADLFSAAKKLYDSVLLSGILTVIDLSTKAPLSASMIQRYDEHREDLKQLKQFVKAS-LPEKYQEIFTDSSK    357
AHN30376        279    LLGQIGDEFADLFSAAKKLYDSVLLSGILTVIDLSTKAPLSASMIQRYDEHREDLKQLKQFVKAS-LPEKYQEIFADSSK    357
EAO78426        279    LLGQIGDEFADLFSAAKKLYDSVLLSGILTVIDLSTKAPLSASMIQRYDEHREDLKQLKQFVKAS-LPEKYQEIFADSSK    357
CCW42055        279    LLGQIGDEFADLFSAAKKLYDSVLLSGILTVTDLSTKAPLSASMIQRYDEHREDLKQLKQFVKAS-LPEKYQEIFADSSK    357
```

-continued

| ID | Sequence | End |
|---|---|---|
| WP_003041502 | LLGEVGDEYADLFASAKNLYDAILLSGLLTVDDNSTKAPLSASMVKRYEEHQKDLKKFEDFIKVN-ALDQYNAIFKDKNK | 356 |
| WP_037593752 | LLGEIGDEYADLFASAKNLYDAILLSGILAVDDNTKAPLSASMVKRYEHQKDLKKLKDFIKVN-APDQYNAIFKDKNK | 357 |
| WP_049516684 | LLGEIGDEYADLFASAKNLYDAILLSGILAVDDNTTKAPLSASMVKRYEHQKDLKKLKDFIKVN-APAQYDDIFKDETK | 357 |
| GAD46167 | LLGEIGDEYADLFASAKNLYDAILLSGILAVDDNTTKAPLSASMVKRYEHQKDLKKLKDFIKAN-APDQYNAIFKDETK | 357 |
| WP_018363470 | LLGKIGDDYADLFTSSKNLYDAILLSDAILLSGILLRSNSEVTKAPLSASMVKRYDEHHQDLALLKLKEFIKAN-KSELYHDIFKDKTQ | 356 |
| WP_003043819 | LLGQIGDQYADLFLSAKNLYDAILLSGILTVDDSTKAPLSASMVKRYDEHHQKDLKKLKDFIKVN-FPEKYAEIFKDDTK | 356 |
| WP_006269658 | FLGEVGDEYADLFSAKNLYDAILLSGILTVDDSTKAPLSASMVKRYDEHHQKDLKKLKDFIKVN-APDQYNAIFKDKNK | 356 |
| WP_048800889 | LLGKIGDDYADLFTSAKNLYDTILLSGILAVDDNSTKAPLSASMIKRYEHQKDLKKLKDFIKVN-APAQYDDIFKDETK | 356 |
| WP_012767106 | LLAQIGDQYADLFLAAKNLSDAILLSDILRVNSEITKAPLSASMIKRYDEHHQDLTLLKALVRQQ-LPEKYKEIFFDQSK | 356 |
| WP_014612333 | LLAQIGNQYADLFLAAKNLSDAILLSDILRVNSEITKAPLSASMIKRYDEHHQDLTLLKALVRQQ-LPEKYKEIFFDQSK | 356 |
| WP_015017095 | LLAQIGDQYADLFLAAKNLSDAILLSDILRVNSEITKAPLSASMIKRYDEHHQDLTLLKALVRQQ-LPEKYKEIFFDQSK | 356 |
| WP_015057649 | LLAQIGDQYADLFLAAKNLSDAILLSDILRVNSEITKAPLSASMIKRYDEHHQDLTLLKALVRQQ-LPEKYKEIFFDQSK | 356 |
| WP_048272715 | LLAQIGDQYADLFLAAKNLSDAILLSDILRVNSEITKAPLSASMIKRYDEHHQDLTLLKALVRQQ-LPEKYKEIFFDQSK | 356 |
| WP_049519324 | LLAQIGDQYADLFLAAKNLSDAILLSDILTESDEITRAPLSASMIKRYREHHKDIVTLKTLIKDQ-LPEKYQEIFLDKTK | 356 |
| WP_012515931 | LLAQIGDQYADLFLAAKNLSDAILLSDILTESDEITRAPLSASMIKRYREHHKDIVTLKTLIKDQ-LPEKYQEIFLDKTK | 356 |
| WP_021320964 | LLAQIGDQYADLFLAAKNLSDAILLSDILTESDEITKAPLSASMIKRYREHHKDIVTLKTLIKDQ-LPEKYQEIFLDKTK | 356 |
| WP_037581760 | LLAQIGDQYADLFLAAKNLSDAILLSDILTESDEITKAPLSASMIKRYREHHKDIVTLKTLIKDQ-LPEKYQEIFLDKTK | 356 |
| WP_004232481 | LLGKIGDDYADLFTAAKNLSDAILLSGILTVDDNSTKAPLSASMIKRYEEHHEDLEKLKTFIKVN-NPDKYHEIFKDKSK | 356 |
| WP_009854540 | LLGKIGDDYADLFTSAKNLYDAILLSGILTVDDNSTKAPLSASMIKRYVEHHEDLEKLKEFIKAN-KSELYHDIFKDKNK | 356 |
| WP_012962174 | LIGKIGDDYADLFTSAKNLYDAILLSGILTVDDNSTKAPLSASMIKRYNEHQVDLKKLKEFIKNN-ASDKYDEIFNDKDK | 357 |
| WP_039995303 | LLGKIGDDYADLFTSAKNLYDAILLSGILTVDDNSTKAPLSASMIKRYEEHHEDLEKLKEFIKAN-KSELYHDIFKDKNK | 357 |
| WP_014334983 | LLGKVGDDYADLFISAKNLYDAILLSGILTVDDNSTKAPLSASMIKRYREHHEDLEKLKEFIKIN-KLKLYHDIFKDKTK | 356 |
| WP_003092269 | LLAQIGDDYADLFLAAKLSDAILLSDILTVKGASTKAPLSASMVQRYEEHQDLALLKNLVKKQ-IPEKYEIFDNKEK | 356 |
| AHY15608 | LLAQIGDQYADLFLAAKLSDAILLSDILTVKGASTKAPLSASMVQRYEEHQDLALLKNLVKKQ-IPEKYEIFDNKEK | 356 |
| AHY17476 | LLAQIGDQYADLFISAKNLYDAILLSGILTVTDVSTKAPLSASMQRYEEHHQDLALLKNLVKKQ-IPEKYKEIFDNKEK | 356 |
| ESR09100 | LLAQIEDDNYAELFLSAKKLYDSILLSGILTVTDVSTKAPLSASMQRYEEHHQDLALLKNLVKKQ-IPEKYKEIFDNKEK | 356 |
| AGM98575 | LLAQIEDDNYAELFLSAKKLYDSILLSGILTVTDVSTKAPLSASMQRYNEHHQMDLAQLKQFIRQK-LSDKYNEVFSDVSK | 356 |
| ALF27331 | LLSKIDEEYAALFDLAKKVDAVLLSNILTVKEKNTKAPLSASMIKRYEHKDDLKAFKRFFRER-LPEKYETMFKDLTK | 354 |
| WP_018372492 | LLVQIGDDFPADLFLVSAKKLYDAILLSGILTVTDPSTKAPLSASMIERYENHQNDLAALKQFIKNN-LPEKYDEVFSDQSK | 357 |
| WP_045618028 | LLGQIGDDFPTDLFVSAKKLYDAILLSGILTVTDPSTKAPLSASMIERYENHQNDLAALKQFIKNN-LPEKYDEVFSDVSK | 356 |
| WP_045635197 | LLAQIGDNYAELFLSAKKLYDSILLSGILTVTDVGTKAPLSASMIQRYNEHQMDLAQLKQFIRQK-LSDKYNEVFSDVSK | 356 |
| WP_002263549 | LLAQIGDNYAELFLSAKKLYDSILLSGILTVTDVGTKAPLSASMIQRYNEHQMDLAQLKQFIRQK-LSDKYNEVFSDVSK | 356 |
| WP_002263887 | LLAQIGDNYAELFLSAKKLYDSILLSGILTVTDVGTKAPLSASMIQRYAEHHEDLEKLKEFIKAN-KPELYHDIFKDETK | 356 |
| WP_002264920 | LLAQIGDNYAELFLSAKKLYDSILLSGILTVTDVSTKAPLSASMIQRYNEHQMDLAQLKQFIRQK-LSDKYNEVFSDVSK | 356 |
| WP_002269043 | LLAQIGDNYAELFLSAKKLYDSILLSGILTVTDVSTKAPLSASMIQRYNEHQMDLAQLKQFIRQK-LSDKYNEVFSDVSK | 356 |
| WP_002269448 | LLAQIGDNYAELFLTAKNLYDSILLSGILTVTDVSTKAPLSASMIQRYNEHQMDLAQLKQFIRQK-LSDKYNEVFSDVSK | 356 |
| WP_002271977 | LLAQIGDNYAELFLTAKNLYDAILLSGILTVTDVSTKAPLSASMIQRYNEHQMDLAQLKQFIRQK-LSDKYNEVFSDVSK | 356 |
| WP_002272766 | LLGKIGDDYADLFTLAKNLYDAILLSGILTVTDPSTKAPLSASMIQRYNEHQMDLAQLKQFIRQK-LSDKYNEVFSDVSK | 356 |
| WP_002273241 | LLAQIGDNYAELFLSAKKLYDSILLSGILTVTDVSTKAPLSASMIQRYNEHQMDLAQLKQFIRQK-LSDKYNEVFSDVSK | 356 |
| WP_002275430 | LLTQIGDNYAELFLSAKKLYDSILLSGILTVTDVSTKAPLSASMIERYENHQNDLAALKQFIRQK-LSDKYNEVFSDVSK | 356 |
| WP_002276448 | LLAQIGDNYAELFLSAKKLYDSILLSGILTVDVGTKAPLSASMIQRYNEHQMDLAQLKQFIRQK-LSDKYNEVFSDVSK | 356 |
| WP_002277050 | LLGKIGDDYADLFTLAKNLYDAILLSGILTVTDADSSTKAPLSASMIKRYAEHHEDLEKLKEFIKAN-KPELYHDIFKDETK | 356 |
| WP_002773364 | LLAQIGDNYAELFLSAKKLYDSILLSGILTVTDVSTKAPLSASMIQRYNEHQMDLAQLKQFIRQK-LSDKYNEVFSDVSK | 356 |
| WP_002779025 | LLAQIGDNYAELFLSAKKLYDSILLSGILTVTDVSTKAPLSASMIQRYNEHQMDLAQLKQFIRQK-LSDKYNEVFSDVSK | 356 |
| WP_002779859 | LLAQIGDNYAELFLSAKKLYDSILLSGILTVTDVSTKAPLSASMIQRYNEHQMDLAQLKQFIRQK-LSDKYNEVFSDVSK | 356 |
| WP_002280230 | LLAQIGDNYAELFLSAKKLYDSILLSGILTVTDVSTKAPLSASMIQRYNEHQMDLAQLKQFIRQK-LSDKYNEVFSDVSK | 356 |
| WP_002281696 | LLAQIGDNYAELFLSAKKLYDSILLSGILTVTDVSTKAPLSASMIQRYNEHQMDLAQLKQFIRQK-LSDKYNEVFSDVSK | 356 |
| WP_002282247 | LLGKIGDDYADLFTLAKNLYDAILLSGILTVTDADSSTKAPLSASMIKRYAEHHEDLEKLKEFIKAN-KPELYHDIFKDETK | 356 |
| WP_002282906 | LLAQIGDNYAELFLSAKKLYDSILLSGILTVTDVSTKAPLSASMIQRYNEHQMDLAQLKQFIRQK-LSDKYNEVFSDVSK | 356 |
| WP_002283846 | LLAQIGDNYAELFLSAKKLYDSILLSGILTVTDVSTKAPLSASMIQRYNEHQMDLTQLKQFIRQK-LSDKYNEVFSDVSK | 356 |
| WP_002872255 | LLAQIGDNYAELFLSAKKLYDSILLSGILTVTDVSTKAPLSASMIQRYNEHQMDLAQLKQFIRQK-LSDKYNEVFSDVSK | 356 |
| WP_002888990 | LLAQIGDNYAELFLSAKKLYDSILLSGILTVTDVSTKAPLSASMIQRYNEHQMDLAQLKQFIRQK-LSDKYNEVFSDVSK | 356 |
| WP_002289641 | LLAQIGDNYAELFLSAKKLYDSILLSGILTVTDVSTKAPLSASMIQRYNEHQMDLAQLKQFIRQK-LSDKYNEVFSDVSK | 356 |
| WP_002290427 | LLAQIGDNYAELFLSAKKLYDSILLSGILTVTDVSTKAPLSASMIQRYNEHQMDLAQLKQFIRQK-LSDKYNEVFSDVSK | 356 |

-continued

| | | | |
|---|---|---|---|
| WP_002295753 | 278 | LLAQIGDNYAELFLSAKKLYDSILLSGILTVTDVSTKAPLSASMIQRYNEHQMDLAQLKQFIRQK- | LSDKYNEVFSDVSK | 356 |
| WP_002296423 | 278 | LLAQIGDNYAELFLSAKKLYDSILLSGILTVTDVSTKAPLSASMIQRYNEHQMDLAQLKQFIRQK- | LSDKYNEVFSDVSK | 356 |
| WP_002304487 | 278 | LLGEIGDEYADLFASAKNLYDAILLSGILAVDDNTTKAPLSASMVKRYKEHKEELAAFKRFIEEK- | LPKKYEEIFKDDTK | 356 |
| WP_002305844 | 278 | LLAQIGDNYAELFLSAKKLYDSILLSGILTVTDVSTKAPLSASMIQRYNEHQMDLAQLKQFIRQK- | LSDKYNEVFSDVSK | 356 |
| WP_002307203 | 278 | LLAQIGDNYAELFLSAKKLYDSILLSGILTVTDVSTKAPLSASMIQRYNEHQMDLAQLKQFIRQK- | LSDKYNEVFSDVSK | 356 |
| WP_002310390 | 278 | LLAQIGDNYAELFLSAKKLYDSILLSGILTVTDVSTKAPLSASMIQRYNEHQMDLAQLKQFIRQK- | LSDKYNEVFSDVSK | 356 |
| WP_002352408 | 278 | LLAQIGDNYAELFLSAKKLYDSILLSGILTVTDVSTKAPLSASMIQRYNEHQMDLAQLKQFIRQK- | LSDKYNEVFSDVSK | 356 |
| WP_012997688 | 278 | LLAQIGDNYAELFLSAKKLYDSILLSGILTVTDVSTKAPLSASMIQRYNEHQMDLAQLKQFIRQK- | LSDKYNEVFSDVSK | 356 |
| WP_014677909 | 278 | LLAQIGDNYAELFLSAKKLYDSILLSGILTVTDVSTKAPLSASMIQRYNEHQMDLAQLKQFIRQK- | LSDKYNEVFSDVSK | 356 |
| WP_019312892 | 278 | LLAQIGDNYAELFLSAKKLYDSILLSGILTVTDVGTQAPLSASMIQRYNEHQMDLAQLKQFIRQK- | LSDKYNEVFSDVSK | 356 |
| WP_019313659 | 278 | LLAQIGDNYAELFLSAKKLYDSILLSGILTVTDVSTKAPLSASMIQRYNEHQMDLAQLKQFIRQK- | LSDKYNEVFSDVSK | 356 |
| WP_019314093 | 278 | LLAQIGDNYAELFLSAKKLYDSILLSGILTVTDVSTKAPLSASMIQRYNEHQMDLAQLKQFIRQK- | LSDKYNEVFSDVSK | 356 |
| WP_019315370 | 278 | LLAQIGDNYAELFLSAKKLYDSILLSGILTVTDVSTKAPLSASMIQRYNEHQMDLTQLKQFIRQK- | LSDKYNEVFSDVSK | 356 |
| WP_019803776 | 278 | LLAQIGDNYAELFLSAKKLYDSILLSGILTVTDVGTQAPLSASMIQRYNEHQMDLAQLKQFIRQK- | LSDKYNEVFSDVSK | 356 |
| WP_019805234 | 278 | LLAQIGDNYAELFLSAKKLYDSILLSGILTVTDVSTKAPLSASMIQRYNEHQMDLAQLKQFIRQK- | LSDKYNEVFSDVSK | 356 |
| WP_024783594 | 278 | LLAQIGDNYAELFLSAKKLYDSILLSGILTVTDVGTKAPLSASMIQRYNEHQMDLAQLKQFIRQK- | LSDKYNEVFSDVSK | 356 |
| WP_024784288 | 278 | LGKIGDDYADLFTLAKNLYDAILLSGILTADDSSTKAPLSASMIKRYAEHHEDLEKLKEFIKAN- | KPELYHDIFKDETK | 356 |
| WP_024784666 | 278 | LLAQIGDNYAELFLSAKKLYDSILLSGILTVTDVSTKAPLSASMIQRYNEHQMDLVQLKQFIRQK- | LSDKYNEVFSDVSK | 356 |
| WP_024784894 | 278 | LLAQIGDNYAELFLSAKKLYDSILLSGILTVTDVSTKAPLSASMIQRYNEHQMDLTQLKQFIRQK- | LSDKYNEVFSDVSK | 356 |
| WP_024786433 | 278 | LGKIGDDYADLFTLAKNLYDAILLSGILTADDSSTKAPLSASMIKRYAEHHEDLEKLKEFIKAN- | KPELYHDIFKDETK | 356 |
| WP_049473442 | 278 | LGKIGDDYADLFTLAKNLYDAILLSGILTADDSSTKAPLSASMIKRYAEHHEDLEKLKEFIKAN- | KPELYHDIFKDETK | 356 |
| WP_049474547 | 278 | LLAQIGDNYAELFLSAKKLYDSILLSGILTVTDVSTKAPLSASMIQRYNEHQMDLAQLKQFIRQK- | LSDKYNEVFSDVSK | 356 |
| EMC03581 | 271 | LLGQIGDDFADLFLSAKKLYDTDPSTKAPLSASMIERYENHQKDLATLKQFIKTN- | LPEKYDEVFSDQSK | 349 |
| WP_000428612 | 279 | LLGGIGDDFADLFLVAKKLYDAILLSGILTVTDPSTKAPLSASMIERYENHQKDLATLKQFIKTN- | LPEKYDEVFSDQSK | 357 |
| WP_000428613 | 278 | LLGGIGDDFADLFLVAKKLYDAILLSGILTVTDPSTKAPLSASMIERYENHQKDLAVLKQFIKNN- | LPEKYDEVFSDQSK | 356 |
| WP_049523028 | 279 | LLGIIGDEVADLFVVAKKLYDAILLAGILSVKDPGTKAPLSASMIERYDNHQNDLSALKQFVRRN- | LPEKYAEVFSDDSK | 357 |
| WP_003107102 | 247 | LLGGQIGDDFADLFLIAAKNLSDAILLSDIILTVTDSGVNTKAPLSASMIQRFNEHQDDLKLLKKLVKVQ- | LPDKYKEIFDIKDK | 325 |
| WP_054279288 | 280 | LLTQIGDEYADLFLSAKNLSDAILLSGILKRYEHRQDLALLKQMFKEQ- | LPDLYRDVFTDENK | 358 |
| WP_049531101 | 279 | LLGGQIGDDFADLFLAKNLSDAILLSGILAILKDPSTKAPLSASLIKRYEHRQDLALLKQMFKEQ- | LPDLYRDVFTDENK | 357 |
| WP_049538452 | 279 | LLGGQIGDDFADLFLVAKKLYDAILLSGILTVTDPSTKAPLSASMIERYQNHQNDLASLKQFIKNN- | LPEKYDEVFSDQSK | 357 |
| WP_049549711 | 279 | LLGGQIGDDFADLFLVAKKLYDAILLSGILTVTDPSTKAPLSASMIERYEHQDLALLKKLVTTLKQFIKNN- | LPEKYDEVFSDQSK | 358 |
| WP_007896501 | 280 | LLAEIGDHYADLFLAAKNLSDAILSDIITLSDENTKAPLSASMIKRYEHQEDLALLLLKKLVKEQ- | MPEKYWEIFSNAKK | 358 |
| EFR44625 | 232 | LLAEIGDHYADLFLAAKNLSDAILSDIITLSDENTRAPLSASMIKRYEHQEDLALLLLKKLVKEQ- | MPEKYWEIFSNAKK | 310 |
| WP_002897477 | 278 | LLGGQIGDDFADLFLIAKKLYDAILLSGILTVTDPSTKAPLSASMIERYENHQKDLAALKQFIKNN- | LSEKYAEVFSDQSK | 356 |
| WP_002906454 | 278 | LLGGQIGDDFADLFLVAKKLYDAILLSGILTVTDPSTKAPLSASMIERYENHQKDLAALKQFIKNN- | LPEKYDEVFSDQSE | 356 |
| WP_009729476 | 279 | LLGGQIGDDFADLFLVAKKLYDAILLSGILTVTNPSTKAPLSASMIERYENHQKDLASLKQFIKNN- | LPEKYDEVFSDQSE | 357 |
| CQR24647 | 278 | LLGIIGDEYADVFVVAKKLYDAILLSGILTVTNNHSTKAPLSASMIDRYDEHNSDKKLLRDFIRTNiGKEVFKEVFYDTSK | 357 |
| WP_000666813 | 279 | LLGGQIGDDFADLFLVAKKLYDAILLSGILTVKDLSTKAPLSASMIERYENHQKDLAALKQFIQNN- | LQEKYDEVFSDQSK | 357 |
| WP_009754323 | 279 | LLGGQIGDDFADLFLVAKKLYDAILLSGILTVTDPSTKAPLSASMIERYENHQKDLAALKQFIKNN- | LPEKYAEVFSDQSK | 357 |
| WP_044674937 | 278 | LLGKIGDDYADLFIATKSLYDGILLAGILSTTDSTTKAPLSSSMVNRYEEHKKDLALLKNFIHQN- | LSDSYKEVENDKLK | 356 |
| WP_044676715 | 278 | LLGKIGDDYADLFIATKSLYDGILLAGILSTTDSTTKAPLSSSMVNRYEEHQDLALLKNFIHQN- | LSDSYKEVENDKLK | 356 |
| WP_044680361 | 278 | LLGKIGDDYADLFIATKSLYDGILLAGILSTTDSTTKAPLSSSMVNRYEEHQKDLALLKNFIHQN- | LSDSYKEVENDKLK | 356 |
| WP_044681799 | 278 | LLGKIGDDYADLFIATKSLYDGILLAGILSTTDSTTKAPLSSSMVNRYEEHQKDLKLDFIKVN- | APDQYNAIFKDKNK | 356 |
| WP_049533112 | 244 | LLGEIGDEYADLFASAKNLYDAILLSDILESMDGYEYFA----- | EAKKESYRKHQEELVLVKKMLKSNaITNDERAKP---EY | 315 |
| WP_029090905 | 284 | LADVLADEEYDLLLTAQKIYSAIILDESMGYEYFA----- | EAKKESYRKHQEELVLVKKMLKSNaITNDERAKP---EY | 360 |
| WP_006506696 | 278 | VEKDLGE-YVEFVDALHNVYSWVELQTIMGATHTD-NASISEAMVSRYNKHHDDLKLLKDCIKNN- | VPNKYFDMFRNDSE | 356 |
| AIT42264 | 284 | LLAQIGDQYADLFLAAKNLSDAILLSKILKTDGKETKAPLSASMIKRYDEHHQDLTLLKALVRQQ- | LPEKYKEIFFDQSK | 362 |
| WP_034440723 | 284 | LLSNIDEGYRDVFLQAKNVNAIELSKILKTDGKETKAPLSAQMVELYNQHREDLIKKYKDYIKAY- | LPEKYGETFKDATK | 362 |
| AKQ21048 | 277 | LLAQIGDQYADLFLAAKNLSDAILLSDILRVNTEITKAPLSAQMVELYNQHREDLTLLKALVRQQ- | LPEKYKEIFFDQSK | 356 |
| WP_004636532 | 284 | LLGMTDDVFLDVFMAAKNVDAVEMSAIISTDTGNSKAVLSNQMINFYDEHKVDLAQLKQFKFKTH- | LPDKYYECFSDPSK | 362 |
| WP_002364836 | 235 | ILAKVGDEYSDVFLAAKNVDAVELSTILADSDKKSHAKLSSSMIVRFTEHQEDLKFKRFIREN- | CPDEYDNLFKNEQQ | 313 |
| WP_016663044 | 21 | ILAKVGDEYSDVFLAAKNVDAVELSTILADSDKKSHAKLSSSMIVRFTEHQEDLKFKRFIREN- | CPDEYDNLFKNEQQ | 99 |
| EMS75795 | - | LLEKSGEEFRDVFLQAKKVDAILLSDILSTKKQNSKAKLSLGMIERYDSHKKDLEELKQFVKAN- | LPEKTAIFFKDSSK | - |
| WP_002373311 | 284 | ILAKVGDEYSDVFLAAKNVDAVELSTILADSDKKSHAKLSSSMIVRFTEHQEDLKFKRFIREN- | CPDEYDNLFKNEQQ | 362 |

-continued

```
WP_002378009  284  ILAKVGDEYSDVFLAAKNVYDAVELSTILADSDKKSHAKLSSSMIVRFTEHQEDLKNFPKRFIREN-CPDEYDNLFKNEQK  362
WP_002407324  284  ILAKVGDEYSDVFLAAKNVYDAVELSTILADSDKKSHAKLSSSMIVRFTEHQEDLKNFPKRFIREN-CPDEYDNLFKNEQK  362
WP_002413717  284  ILAKVGDEYSDVFLAAKNVYDAVELSTILADSDKKSHAKLSSSMIVRFTEHQEDLKNFPKRFIREN-CPDEYDNLFKNEQK  362
WP_010775580  286  ILAKVGDEYSDVFLAAKNVYDAVELSTILADSDKKSHAKLSSSMIVRFTEHQEDLKNFPKRFIREN-CPDEYDNLFKNEQK  364
WP_010818269  284  ILAKVGDEYSDVFLAAKNVYDAVELSTILADSDKKSHAKLSSSMIVRFTEHQEDLKNFPKRFIREN-CPDEYDNLFKNEQK  362
WP_010824395  284  ILAKVGDEYSDVFLAAKNVYDAVELSTILADSDKKSHAKLSSSMIVRFTEHQEDLKNFPKRFIKEN-CPDEYDNLFKNEQK  362
WP_016622645  284  ILAKVGDEYSDVFLAAKNVYDAVELSTILADSDKKSHAKLSSSMIVRFTEHQEDLKNFPKRFIREN-CPDEYDNLFKNEQK  362
WP_036624816  284  ILAKVGDEYSDVFLAAKNVYDAVELSTILADSDKKSHAKLSYAKLSSSMIVRFTEHQEDLKNFPKRFIREN-CPDEYDNLFKNEQK  362
WP_033625576  284  ILAKVGDEYSDVFLAAKNVYDAVELSTILADSDKKSHAKLSSSMIVRFTEHQEDLKNFPKRFIREN-CPDEYDNLFKNEQK  362
WP_033789179  284  ILAKVGDEYSDVFLAAKNVYDAVELSTILADSDKKSHAKLSSSMIVRFTEHQEDLKNFPKRFIREN-CPDEYDNLFKNEQK  362
WP_002310644  282  LLEKIGDDYIDLFVQAKNVYDAVLLSEILSDSTKNTRAKLSAGMIRRYDAHKEDIVLLKRFVKEN-LPKKYRAFFGDNSV  360
WP_002312694  283  LLEKIGDDYIDLFVQAKNVYDAVLLSEILSDSTKNTRAKLSAGMIRRYDAHKEDIVLLKRFVKEN-LPKKYRAFFGDNSV  361
WP_002314015  283  LLEKIGDDYIDLFVQAKNVYDAVLLSEILSDSTKNTRAKLSAGMIRRYDAHKEDIVLLKRFVKEN-LPKKYRAFFGDNSV  361
WP_002220716  282  LLEKIGDDYIDLFVQAKNVYDAVLLSEILSDSTKNTRAKLSAGMIRRYDAHKEDIVLLKRFVKEN-LPKKYRAFFGDNSV  360
WP_002330729  283  LLEKIGDDYIDLFVQAKNVYDAVLLSEILSDSTKNTRAKLSAGMIRRYDAHKEDIVLLKRFVKEN-LPKKYRAFFGDNSV  361
WP_002335161  283  LLEKIGDDYIDLFKAKGVYDAILLSQILSKSDDTKAKLSAGMIRRYDAHKEDIVLLKRFVKEN-LPKKYRAFFGDNSV  361
WP_002345439  283  LLEKIGDDYIDLFVQAKNVYDAVLLSEILSDSTKNTRAKLSAGMIRRYDAHKEDIVLLKRFVKEN-LPKKYRAFFGDNSV  361
WP_034867970  276  LLEKIGDDYELDIFLQAKKVHDAILLSEIISSTVKHTKAKLSSGMVERYERHKADLAKFKQFVKEN-VPQKATVFFKDTTK  354
WP_047937432  283  LLEKIGDDYIDLFVQAKNVYDAVLLSEILSDSTKNTRAKLSAGMIRRYDAHKEDIVLLKRFVKEN-LPKKYRAFFGDNSV  361
WP_010720994  276  LLEKIGDEYLDIFLQAKKVHDAILLSEIISSTVKHTQAKLSSGMVERYERHKADLAKFKQFVKEN-VPQKATVFFKDTTK  354
WP_002314221  276  LLEKIGDEYLDIFLQAKKVHDAILLSEIISSTVKHTKAKLSSGMVERYERHKADLAKFKQFVKEN-VPQKATVFFKDTTK  354
WP_010737004  276  LLEKIGDEYLDIFLQAKKVHDAILLSEIISSTVKHTQAKLSSGMVERYERHKADLAKFKQFVKEN-VPQKATVFFKDTTK  354
WP_034700478  281  LLAIIGDEYGDIFVAAQNIYQAILLAGILTSTEK-TRAKLSASMIQRYEBHAKDLKLLKRFVKEH-IPDKYAEIFNDATK  358
WP_007209003  276  LLEKTSDDYAELFLKAKGVYDAILLSQLLSKSDDETKAKLSANMKLRFEEHQRDLKQLKELVRRD-LPKKYDDFFKNRSK  354
WP_023519017  276  LLAIIGDEYAEIFSATKSVYDAVALSGILSVTDGDTKAKLSASMIRRYEAHQKDIVQFKQFIRKE-LPEMYAPIFRDNSV  354
WP_010770040  279  LLAIIGDEYAEIFSATKSVYDAVALSGILSVTDGDTKAKLSASMERYEAHQKDIVQFKQFIRKE-LPEMYAPIFRDNSV  357
WP_048604708  275  LLGEIGDEYADVFEAAKNVNAVELSGILTVTDNSTKAKLSASMIKRYEDHKTDLKFKEFIRKN-LPEKYHEIFPNDKNT  353
WP_010750235  276  LLRKSNEEMIDVFLQVKKVYDAILLSDILSTKMKDTKAKLSAGMIERYQNHKKDLEELKQFVRAH-LHEKVTVFFKDSSK  354
AII16583      317  LLAQIGDQYADLFLAAKNLSDAILLSDILRVNTETTKAPLSASMIQRYEDHKNDLTLLKALVRQQ-LPEKYKEIFFDQSK  395
WP_029073316  290  KQPLLGD-CVEFIDLLHDIYSWVELQNILGSAHTS-EPSISAAMIQRYEDHKNDLKLLKDVIRKY-LPEKYFEVFRDEKS  366
WP_031589969  290  KQPLLGD-CVEFIDLLHDIYSWVELQNILGSAHTS-EPSISAAMIQRYEDHKNDLIELKRVFKY-LPEKCHDFFSE-PK  353
KDA45870      276  LLAEAGDQYIDLFVAAKKVYDAAILASILDVKDTQTKTVFSQAMIERYEHQKDLIELKRVFKY-LPEKCHDFFSE-PK  359
AKP02966      279  LESSLDDNAHQIIRSLQELYSGVLLAGIVPENQSLS---QAMITKYDDHQKHLMKLKAVREAL-APEDRQRLKQAYDQ  348
WP_010991369  284  LDSILDDDQFTVLDTANRIYSTITLNELL--NGESYFPSMAKVNQYENHAIDLCKLRDMWHT----KNEKAV-GLSR  362
WP_033838504  284  LLALIGDEYAELFVAAKNAYSAVVLSSIITVAETETNAKLSASMIERFDTHEEDLGELKAFIKLH-LPKHYEEIFSNTEK  362
EHN60060      287  LLALIGDEYAELFVAAKNAYSAVVLSSIITVAETETNAKLSASMIERFDTHEEDLGELKAFIKLH-LPKHYEEIFSNTEK  365
EFR89594      53   LLALIGDEYAELFVAAKNAYSAVVLSSIITVAETETNAKLSASMIERFDTHEEDLGELKAFIKLH-LPKHYEEIFSNTEK  131
WP_038409211  284  LLAKIGDEYAELFVAAKSTYNAVLSNIITVTDTFETNAKLSASMIERFDKHAKDLKRLKAFFKMQ-LPEKFNEVFNDIEK  362
EFR95520                ---------------------------------------------------------------------------
WP_003723650  284  LLAIIGDEYAELFVAAKNTYNAVLSSIITVNAVLSSIITVDTETNAKLSASMIERFDAHEKDLVELKAFIKLN-LPKQYEEIFSNAAI  362
WP_003727705  284  LLAIIGDEYAELFVAAKNTYNAVLSSIITVTATETNAKLSASMIERFDAHEKELGELKAFIKLH-LPKQYQEIFNNAEI  362
WP_003730785  284  LLAIIGDEYAELFVAAKNTYNAVLSSIITVTDTETNAKLSASMIERFDAHEKEDLGELKAFIKLH-LPKQYQEIFNNAAI  362
WP_003733029  284  LLAIIGDEYAELFVAAKNTYNAVLSNIITVTDSTTRAKLSASLIERFENHKEDLKKMRFVRTY-LPEKYDEIFDDTEK  362
WP_003739838  284  LLAIIGDEYAELFVAEVFVAAKNAYNAVLSSIITVTDTETNAKLSASLIERFENNKEDLSELKAFIKLH-LPKYDEIFSNVAI  362
WP_014601172  284  LLALIGDEYAELFVAAKNTYNAVLSNIITVTATETNAKLSASMIERFDAHEKEDLGELKAFIKLH-LPKQYEEIFNNAAI  362
WP_023548323  284  LLAIIGDEYAELFVAAKNAYSAVVLSSIITVAETETNAKLSASMIERFDAHEKDLVELKAFIKLN-LPKQYEEIFNNAAI  362
WP_031665337  284  LLAIIGDEYAELFVAAKNAYNAVLSSIITVNDETETNAKLSASMIERFDTHEEDLGELKAFIKLH-LPKHYEEIFSNTEK  362
WP_031669209  284  LLAIIGDEYAELFVAAKNTYNAVLSSIITVTDSTTRAKLSASLIERFENHKEDLKKMRFVRTY-LPEKYDEIFDDTEK  362
WP_033920898  284  LLAIIGDEYAELFVAAKNTYNAVLSSIITVTATETNAKLSASMIERFDAHEKEDLGELKAFIKLN-LPKQYQEIFNNAAI  362
AKI42028      287  LLAIIGDEYAELFVAAKNTYNAVLSSIITVTATETNAKLSASMIERFDAHEKEDLGELKAFIKLH-LPKQYQEIFNNAAI  365
AKI50529      287  LLAIIGDEYAELFVAAKNTYNAVLSSIITVTATETNAKLSASMIERFDAHEKEDLGELKAFIKLN-LPKQYQEIFNNAAI  365
EFR83390                ---------------------------------------------------------------------------
WP_046323366  284  LLARVGDEYAEIFVAAKNAYNAVNAVLSSIITVSNFETKAKLSASMIERFDKHDKDLKRMCAFFKVR-LPENFNEVFNDVEK  362
AKE81011      294  LLAQIGDQYADLFLAAKNLSDAILLSDILRVNTEITKAPLSASMIKRYDEHHQDLTLLKALVRQQ-LPEKYKEIFFDQSK  372
```

```
                                                                                           -continued
CUO82355         288 VENDLGE-YVEFIDSLHNIYSWVELQTIMGATHTD-NASISEAMVSRYNKHHEDLQLLKKCIKDN-VPKKYFDMPRNDSE    364
WP_033162887     289 LQSELGE-YIEFIEMLHNIYSWVELQAILGATHTD-NPSISAAMVERYEHKKDIRVLLKKVIREE-LPDKYNEVFRKDNR    365
AGZ01981         311 LLAQIGDQYADLFLAAKNLSDAILLSDIILRVNTEITKAPLSASMIKRYDEHHQDLTLLKAPLSRQQ-LPEKYKEIFFDQSK   389
AKA60242         278 LLAQIGDQYADLFLAAKNLSDAILLSDIILRVNTEITKAPLSASMIKRYDEHHQDLTLLKALVRQQ-LPEKYKEIFFDQSK    356
AKS40380         278 LLAQIGDQYADLFLAAKNLSDAILLSDIILRVNTEITKAPLSASMIKRYDEHHQDLTLLKALVRQQ-LPEKYKEIFFDQSK    356
4UN5_B           282 LLAQIGDQYADLFLAAKNLSDAILLSDIILRVNTEITKAPLSASMIKRYDEHHQDLTLLKALVRQQ-LPEKYKEIFFDQSK    360

WP_010922251     357 --NGYAG YIDG G ASQEEFYKFIKPILEK-M--DGTEELLv--KLNREDLLRKQRTFDNGSIPHQIHLGEL                 419
WP_039695303     358 --NGYAG YIEN G VKQDEFYKYLKNILSK-IkiDGSDYFL--DKIEREDFLRKQRTFDNGSIPHQIHLQEM                 422
WP_045635197     357 --DGYAG YIDG G TTQETFYKYIKNLLSK-F--EGTDYFL--DKIEREDFLRKQRTFDNGSIPHQIHLQEM                 419
5AXW_A           169 -----G  SINR - ------TSDYVk                                                              183
WP_009880683      41 --NGYAG YIDG G ASQEEFYKFIKPILEK-M--DGTEELLa--KLNREDLLRKQRTFDNGSIPHQIHLGEL                 103
WP_010922251     357 --NGYAG YIDG G ASQEEFYKFIKPILEK-M--DGTEELLv--KLNREDLLRKQRTFDNGSIPHQIHLGEL                 419
WP_011054416     357 --NGYAG YIDG G ASQEEFYKFIKPILEK-M--DGTEELLa--KLNREDLLRKQRTFDNGSIPHQIHLGEL                 419
WP_011284745     357 --NGYAG YIDG G ASQEEFYKFIKPILEK-M--DGTEELLv--KLNREDLLRKQRTEDNGSIPYQIHLGEL                 419
WP_011285506     357 --NGYAG YIDG G ASQEEFYKFIKPILEK-M--DGTEELLa--KLNREDLLRKQRTEDNGSIPHQIHLGEL                 419
WP_011527619     357 --NGYAG YIDG G ASQEEFYKFIKPILEK-M--DGTEELLa--KLNREDLLRKQRTFDNGSIPHQIHLGEL                 419
WP_012560673     357 --NGYAG YIDG G ASQEEFYKFIKPILEK-M--DGTEELLv--KLNREDLLRKQRTFDNGSIPHQIHLGEL                 419
WP_014407541     357 --NGYAG YIDG G ASQEEFYKFIKPILEK-M--DGTEELLa--KLNREDLLRKQRTFDNGSIPHQIHLGEL                 419
WP_020905136     357 --NGYAG YIDG G ASQEEFYKFIKPILEK-M--DGTEELLa--KLNREDLLRKQRTFDNGSIPHQIHLGEL                 419
WP_023080005     357 --NGYAG YIDG G ASQEEFYKFIKPILEK-M--DGTEELLa--KLNREDLLRKQRTFDNGSIPYQIHLGEL                 419
WP_023612082     357 --NGYAG YIDG G ASQEEFYKFIKPILEK-M--DGTEELLv--KLNREDLLRKQRTFDNGSIPYQIHLGEL                 419
WP_030125963     357 --NGYAG YIDG G ASQEEFYKFIKPILEK-M--DGTEELLa--KLNREDLLRKQRTFDNGSIPHQIHLGEL                 419
WP_030126706     357 --NGYAG YIDG G ASQEEFYKFIKPILEK-M--DGTEELLv--KLNREDLLRKQRTFDNGSIPYQIHLGEL                 419
WP_031488318     357 --NGYAG YIDG G ASQEEFYKFIKPILEK-M--DGTEELLa--KLNREDLLRKQRTFDNGSIPHQIHLGEL                 419
WP_032460140     357 --NGYAG YIDG G ASQEEFYKFIKPILEK-M--DGTEELLa--KLNREDLLRKQRTFDNGSIPHQIHLGEL                 419
WP_032461047     357 --NGYAG YIDG G ASQEEFYKFIKPILEK-M--DGTEELLa--KLNREDLLRKQRTFDNGSIPHQIHLGEL                 419
WP_032462016     357 --NGYAG YIDG G ASQEEFYKFIKPILEK-M--DGTEELLa--KLNREDLLRKQRTFDNGSIPHQIHLGEL                 419
WP_032462936     357 --NGYAG YIDG G ASQEEFYKFIKPILEK-M--DGTEELLv--KLNREDLLRKQRTFDNGSIPHQIHLGEL                 419
WP_032464890     182 --NGYAG YIDG G ASQEEFYKFIKPILEK-M--DGTEELLa--KLNREDLLRKQRTFDNGSIPHQIHLGEL                 244
WP_033888930     357 --NGYAG YIDG G ASQEEFYKFIKPILEK-M--DGTEELLa--KLNREDLLRKQRTFDNGSIPYQIHLGEL                 419
WP_038431314     357 --NGYAG YIDG G ASQEEFYKFIKPILEK-M--DGTEELLv--KLNREDLLRKQRTFDNGSIPHQIHLGEL                 419
WP_038432938     357 --NGYAG YIDG G ASQEEFYKFIKPILEK-M--DGTEELLa--KLNREDLLRKQRTFDNGSIPHQIHLGEL                 419
WP_038434062     268 --NGYAG YIDG G ASQEEFYKFIKPILEK-M--DGTEELLv--KLNREDLLRKQRTFDNGSIPHQIHLGEL                 330
BAQ51233         357 -----   ----  - ---------------                                                          
KGE60856                                                                                                
KGE60162                                                                                                
WP_002989955     357 --NGYAG YIDG G ASQEEFYKFIKPILEK-M--DGTEELLa--KLNREDLLRKQRTFDNGSIPHQIHLGEL                 419
WP_003030002     357 --KGYAG YIEN G VKQDEFYKYLKGILLQ-I--NGSGDFL--DKIDREDFLRKQRTFDNGSIPHQIHLQEM                 419
WP_003065552     360 --DGYAG YIDG G VKQDEFYKYLKNTLSK-Ia--GSDYFL--DKIEREDFLRKQRTFDNGSIPHQIHLQEM                 422
WP_001040076     358 --DGYAG YIEG K TNQEAFYKYLSKLLTK-Q--EGSEYFL--EKIKNEDFLRKQRTFDNGSIPHQVHLTEL                 420
WP_001040078     358 --DGYAG YIEG K TNQEAFYKYLSKLLTK-Q--EDSENFL--EKIKNEDFLRKQRTFDNGSIPHQVHLTEL                 420
WP_001040080     358 --DGYAG YIEG K TNQEAFYKYLSKLLTK-Q--EDSENFL--EKIKNEDFLRKQRTFDNGSIPHQVHLTEL                 420
WP_001040081     358 --DGYAG YIEG K TNQEAFYKYLSKLLTK-Q--EDSENFL--EKIKNEDFLRKQRTFDNGSIPHQVHLTEL                 420
WP_001040083     358 --DGYAG YIEG K TNQEAFYKYLSKLLTK-Q--EDSENFL--EKIKNEDFLRKQRTFDNGSIPHQVHLTEL                 420
WP_001040085     358 --DGYAG YIEG K TNQEAFYKYLSKLLTK-Q--EDSENFL--EKIKNEDFLRKQRTFDNGSIPHQVHLTEL                 420
WP_001040087     358 --DGYAG YIEG K TNQEAFYKYLSKLLTK-Q--EDSENFL--EKIKNEDFLRKQRTFDNGSIPHQVHLTEL                 420
WP_001040088     358 --DGYAG YIEG K TNQEAFYKYLSKLLTK-Q--EDSENFL--EKIKNEDFLRKQRTFDNGSIPHQVHLTEL                 420
WP_001040089     358 --DGYAG YIEG K TNQEAFYKYLSKLLTK-Q--EDSENFL--EKIKNEDFLRKQRTFDNGSIPHQVHLTEL                 420
WP_001040090     358 --DGYAG YIEG K TNQEAFYKYLSKLLTK-Q--EDSEYFL--EKIKNEDFLRKQRTFDNGSIPHQVHLTEL                 420
WP_001040091     358 --DGYAG YIEG K TNQEAFYKYLSKLLTK-Q--EDSENFL--EKIKNEDFLRKQRTFDNGSIPHQVHLTEL                 420
WP_001040092     358 --DGYAG YIEG K TNQEAFYKYLSKLLTK-Q--EDSEYFL--EKIKNEDFLRKQRTFDNGSIPHQVHLTEL                 420
WP_001040094     358 --DGYAG YIEG K TNQEAFYKYLSKLLTK-Q--EGSEYLL--EKIKNEDFLRKQRTFDNGSIPHQVHLTEL                 420
```

```
WP_001040095  358  -DGYAG  YIEG  K  TNQEAFYKYLSKLLTK-Q--EGSEYLL--EKIKNEDFLRKQRTFDNGSIPHQVHLTEL  420
WP_001040096  358  -DGYAG  YIEG  K  TNQEAFYKYLSKLLTK-Q--EGSEYLL--EKIKNEDFLRKQRTFDNGSIPHQVHLTEL  420
WP_001040097  358  -DGYAG  YIEG  K  TNQEAFYKYLSKLLTK-Q--EGSEYLL--EKIKNEDFLRKQRTFDNGSIPHQVHLTEL  420
WP_001040098  358  -DGYAG  YIEG  K  TNQEAFYKYLSKLLTK-Q--EGSEYLL--EKIKNEDFLRKQRTFDNGSIPHQVHLTEL  420
WP_001040099  358  -DGYAG  YIEG  K  TNQEAFYKYLSKLLTK-Q--EGSEYLL--EKIKNEDFLRKQRTFDNGSIPHQVHLTEL  420
WP_001040100  358  -DGYAG  YIEG  K  TNQEAFYKYLSKLLTK-Q--EGSEYLL--EKIKNEDFLRKQRTFDNGSIPHQVHLTEL  420
WP_001040104  358  -DGYAG  YIEG  K  TNQEAFYKYLSKLLTK-Q--EDSENFL--EKIKNEDFLRKQRTFDNGSIPHQVHLTEL  420
WP_001040105  358  -DGYAG  YIEG  K  TNQEAFYKYLSKLLTK-Q--EDSENFL--EKIKNEDFLRKQRTFDNGSIPHQVHLTEL  420
WP_001040106  358  -DGYAG  YIEG  K  TNQEAFYKYLSKLLTK-Q--EGSEYFL--EKIKNEDFLRKQRTFDNGSIPHQVHLTEL  420
WP_001040107  358  -DGYAG  YIEG  K  TNQGAFYKYLSKLLTK-Q--EGSEYFL--EKIKNEDFLRKQRTFDNGSIPHQVHLTEL  420
WP_001040108  358  -DGYAG  YIEG  K  TNQEAFYKYLSKLLTK-Q--EGSEYFL--EKIKNEDFLRKQRTFDNGSIPHQVHLTEL  420
WP_001040109  358  -DGYAG  YIEG  K  TNQEAFYKYLSKLLTK-Q--EGSEYFL--EKIKNEDFLRKQRTFDNGSIPHQVHLTEL  420
WP_001040110  358  -DGYAG  YIEG  K  TNQGAFYKYLSKLLTK-Q--EGSEYFL--EKIKNEDFLRKQRTFDNGSIPHQVHLTEL  420
WP_015058523  358  -DGYAG  YIEG  K  TNQEAFYKYLSKLLTK-Q--EGSEYFL--EKIKNEDFLRKQRTFDNGSIPHQVHLTEL  420
WP_017643650  358  -DGYAG  YIEG  K  TNQEAFYKYLSKLLTK-Q--EDSENFL--EKIKNEDFLRKQRTFDNGSIPHQVHLTEL  420
WP_017647151  358  -DGYAG  YIEG  K  TNQEAFYKYLSKLLTK-Q--EDSENFL--EKIKNEDFLRKQRTFDNGSIPHQVHLTEL  420
WP_017648376  358  -DGYAG  YIEG  K  TNQEAFYKYLSKLLTK-Q--EDSENFL--EKIKNEDFLRKQRTFDNGSIPHQVHLTEL  420
WP_017649527  358  -DGYAG  YIEG  K  TNQEAFYKYLSKLLTK-Q--EGSEYFL--EKIKNEDFLRKQRTFDNGSIPHQVHLTEL  420
WP_017771611  358  -DGYAG  YIEG  K  TNQGAFYKYLSKLLTK-Q--EDSENFL--EKIKNEDFLRKQRTFDNGSIPHQVHLTEL  420
WP_017771984  358  -DGYAG  YIEG  K  TNQEAFYKYLSKLLTK-Q--EDSENFL--EKIKNEDFLRKQRTFDNGSIPHQVHLTEL  420
CFQ25032      358  -DGYAG  YIEG  K  TNQEAFYKYLSKLLTK-Q--EDSENFL--EKIKNEDFLRKQRTFDNGSIPHQVHLTEL  420
CFV16040      358  -DGYAG  YIEG  K  TNQEAFYKYLSKLLTK-Q--EGSEYFL--EKIKNEDFLRKQRTFDNGSIPHQVHLTEL  420
KLJ37842      358  -DGYAG  YIEG  K  TNQGAFYKYLSKLLTK-Q--EDSENFL--EKIKNEDFLRKQRTFDNGSIPHQVHLTEL  420
KLJ72361      358  -DGYAG  YIES  K  TNQEAFYKYLSKLLTK-Q--EGSEYFL--EKIKNEDFLRKQRTFDNGSIPHQVHLTEL  420
KLL20707      358  -DGYAG  YIEG  K  TNQEAFYKYLSKLLTK-Q--EGSEYFL--EKIKNEDFLRKQRTFDNGSIPHQVHLTEL  420
KLL42645      358  -DGYAG  YIEG  K  TNQGAFYKYLSKLLTK-Q--EDSENFL--EKIKNEDFLRKQRTFDNGSIPHQVHLTEL  420
WP_047207273  358  -DGYAG  YIEG  K  TNQEAFYKYLSKLLTK-Q--EGSEYFL--EKIKNEDFLRKQRTFDNGSIPHQVHLTEL  420
WP_047209694  358  -DGYAG  YIEG  K  TNQGAFYKYLSKLLTK-Q--EDSENFL--EKIKNEDFLRKQRTFDNGSIPHQVHLTEL  420
WP_050198062  358  -DGYAG  YIEG  K  TNQEAFYKYLSKLLTK-Q--EDSENFL--EKIKNEDFLRKQRTFDNGSIPHQVHLTEL  420
WP_050201642  358  -DGYAG  YIEG  K  TNQEAFYKYLSKLLTK-Q--EDSENFL--EKIKNEDFLRKQRTFDNGSIPHQVHLTEL  420
WP_050204027  358  -DGYAG  YIEG  K  TNQGAFYKYLSKLLTK-Q--EDSENFL--EKIKNEDFLRKQRTFDNGSIPHQVHLTEL  420
WP_050881965  358  -DGYAG  YIES  K  TNQEAFYKYLSKLLTK-Q--EDSENFL--EKIKNEDFLRKQRTFDNGSIPHQVHLTEL  420
WP_050886065  358  -DGYAG  YIEG  K  TNQEAFYKYLSKLLTK-Q--EDSENFL--EKIKNEDFLRKQRTFDNGSIPHQVHLTEL  420
AHN30376      358  -DGYAG  YIEG  K  TNQEAFYKYLSKLLTK-Q--EGSEYLL--EKIKNEDFLRKQRTFDNGSIPHQVHLTEL  420
EAO78426      358  -KGYAG  YVGI  G  VKQDEFYKYLKGILLQ-I--NGSGDFL--DKIDREDFLRKQRTFDNGSIPHQIHLQEM  420
CCW42055      358  -KGYAG  YIES  G  VKQDEFYKYLKGILLK-I--NGSGDFL--DKIDREDFLRKQRTFDNGSIPHQIHLQEM  420
WP_003041502  358  -KGYAG  YIEN  G  VEQDEFYKYLKNTLSK-I--DGSDYFL--DKIDCEDFLRKQRTFDNGSIPHQIHLGEM  420
WP_037593752  358  -NGYAG  YIEG  G  VKQDEFYKYLKPILEK-M--DGTEELLa-DKIDREDFLRKQRTFDNGSIPHQIHLGEM  419
WP_049516684  358  -KGYAG  YIEN  G  VKQDEFYKYLKGILLK-I--NGSGDFL--DKIDCEDFLRKQRTFDNGSIPHQIHLGEM  420
GAD46167      358  -NGYAG  YIDG  G  ATQEEFYKYLKPILEK-M--DGAEELLa-KLNRDDLLRKQRTFDNGSIPHQIHLKEL  429
WP_018363470  357  -KGYAS  YIES  G  VKQDEFYKYLKPILEK-M--NGSGDFL--DKIDREDFLRKQRTFDNGSIPHQIHLGEL  419
WP_003043819  357  -NGYAG  YIDG  G  ASQEEFYKFIKPILEK-M--DGTEELLa-KLNREDLLRKQRTFDNGSIPHQIHLGEL  419
WP_006269658  357  -NGYAG  YIEN  G  ASQEEFYKFIKPILEK-M--DGTEELLa-KLNREDLLRKQRTFDNGSIPHQIHLGEL  419
WP_048800889  357  -NGYAG  YIEN  G  ASQEEFYKFIKPILEK-M--DGTEELLa-KLNREDLLRKQRTFDNGSIPHQIHLGEL  419
WP_012767106  357  -NGYAG  YIDG  G  ASQEEFYKFIKPILEK-M--DGTEELLa-KLNREDLLRKQRTFDNGSIPHQIHLGEL  419
WP_014612333  357  -NGYAG  YIEG  G  ASQEEFYKFIKPILEK-M--DGTEELLa-KIDREDLLRKQRTFDNGSIPHQIHLGEL  419
WP_015017095  357  -NGYAG  YIDG  G  VSQEEFYKYLKPILAR-L--DGSEPLLl-KIDREDFLRKQRTFDNGSIPHQIHLEEL  419
WP_015057649  357  -NGYAG  YIDG  G  VSQEEFYKYLKPILAR-L--DGSEPLLl-KIDREDFLRKQRTFDNGSIPHQIHLEEL  419
WP_048272715  357  -NGYAG  YIEG  Q  VSQEEFYKYLKPILAR-L--DGSEPLLl-KIDREDFLRKQRTFDNGSIPHQIHLEEL  419
WP_049519324  357  -NGYAG  YIEG  Q  VSQEEFYKYLKPILAR-L--DGSEPLLl-KIDREDFLRKQRTFDNGSIPHQIHLEEL  419
WP_012515931  357  -NGYAG  YIEG  G  VSQEEFYKYLKPILAR-L--DGSEPLLl-KIDREDFLRKQRTFDNGSIPHQIHLEEL  419
WP_021320964  357  -NGYAG  YIEG  G  VSQEEFYKYLKPILAR-L--DGSEPLLl-KIDREDFLRKQRTFDNGSIPHQIHLEEL  419
WP_037581760  357  -NGYAG  YIEG  G  VSQEEFYKYLKPILAR-L--DGSEPLLl-KIDREDFLRKQRTFDNGSIPHQIHLEEL  419
WP_004232481  357  -NGYAG  YIEN  G  VKQDIFYKHLKSIISE-K--NGGQYFL--DKIEREDFLRKQRTFDNGSIPYQIHLQEM  419
```

```
WP_009854540  358  --NGYAG  YIEN  G  VKQDEFYKYLKNTLSK-I--DGSDYFL--DKIEREDFLRKQRTFDNGSIPHQIHLQEM   420
WP_012962174  358  --NGYAG  YIEN  G  VKQDEFYKYLKTTLSK-I--DGSDYFL--DKIEREDFLRKQRTFDNGSIPHQIHLQEM   420
WP_039695303  358  --NGYAG  YIEN  G  VKQDEFYKYLKNILSK-IkiDGSDYFL--DKIERDDFLRKQRTFDNGSIPHQIHLQEM   422
WP_014334983  357  --NGYAG  YIDN  G  VKQDEFYKYLKTILTK-I--DDSDYFL--DKIEREDFLRKQRTFDNGSIPHQIHLNEL   419
WP_003099269  357  --NGYAG  YIDG  K  TSQEEFYKYIKPILLK-L--DGTEKLIs--KLEREDFLRKQRTFDNGSIPHQIHLNEL   419
AHY15608      357  --NGYAG  YIDG  K  TSQEEFYKYIKPILLK-L--DGTEKLIs--KLEREDFLRKQRTFDNGSIPHQIHLNEL   419
AHY17476      ---  ------   ----  -  TSQEEFYKYIKPILLK-L--DGTEKLIs--KLEREDFLRKQRTFDNGSIPHQIHLNEL   419
ESR09100      ---  ------   ----  -  ------------------------------------------------------------   ---
AGM98575      357  --NGYAG  YIDG  K  TSQEEFYKYLKGLLNK-I--DGTEKLIs--KLEREDFLRKQRTFDNGSIPHQIHLNEL   419
ALF27331      357  --DGYAG  YIDG  K  TNQEAFYKYLKGLLNK-I--EGSGYFL--DKIEREDFLRKQRTFDNGSIPHQIHLQEM   419
WP_018372492  355  --PSYAA  YVSG  A  VTEDDFYKFSKGLLID-V--EGAEYFL--EKIEREDFLRKQRTFDNGAIPNQVHVKEL   432
WP_045618028  358  --DGYAG  YIDG  K  TTQEAFYKYLKNILSK-L--EGADYFL--DKIEREDFLRKQRTFDNGSIPHQIHLQEM   420
WP_045635197  357  --DGYAG  YIDG  K  TTQETFYKYIKNLLSK-F--EGTDYFL--DKIEREDFLRKQRTFDNGSIPHQIHLQEM   419
WP_002263549  357  --DGYAG  YIDG  K  TNQEAFYKYLKGLLNK-I--EGSGYFL--DKIEREDFLRKQRTFDNGSIPHQIHLQEM   419
WP_002263887  357  --DGYAG  YIDG  K  TNQEAFYKYLKGLLNK-I--EGSGYFL--DKIEREDFLRKQRTFDNGSIPHQIHLQEM   419
WP_002264920  357  --NGYAG  YIEN  G  VKQEAFYKYLKNTLNK-I--AGSDYFL--DKIEREDFLRKQRTFDNGSIPHQIHLQEM   419
WP_002269043  357  --DGYAG  YIDG  K  TNQEAFYKYLKGLLNK-I--EGSGYFL--DKIEREDFLRKQRTFDNGSIPHQIHLQEM   419
WP_002269448  357  --DGYAG  YIDG  K  TSQEEFYKYLKGLLNK-I--EGSGYFL--DKIEREDFLRKQRTFDNGSIPHQIHLQEM   419
WP_002271977  357  --DGYAG  YIDG  K  TNQEAFYKYLKGLLNK-I--EGSGYFL--DKIEREDFLRKQRTFDNGSIPHQIHLQEM   419
WP_002272766  357  --DGYAG  YIDG  K  TNQEAFYKYLKGLLNK-I--EGSGYFL--DKIEREDFLRKQRTFDNGSIPHQIHLQEM   419
WP_002273241  357  --DGYAG  YIDG  K  TNQEAFYKYLKGLLNK-I--EGSGYFL--DKIEREDFLRKQRTFDNGSIPHQIHLQEM   419
WP_002275430  357  --DGYAG  YIDG  K  TNQEAFYKYLKGLLNK-I--EGSGYFL--DKIEREDFLRKQRTFDNGSIPHQIHLQEM   419
WP_002276448  357  --NGYAG  YIEN  G  VKQDEFYKYLKGLLNK-I--EGSGYFL--DKIEREDFLRKQRTFDNGSIPHQIHLQEM   419
WP_002277050  357  --DGYAG  YIDG  K  TNQEAFYKYLKNTLSK-I--AGSDYFL--DKIEREDFLRKQRTFDNGSIPHQIHLQEM   419
WP_002277364  357  --DGYAG  YIDG  K  TNQEAFYKYLKGLLNK-I--EGSGYFL--DKIEREDFLRKQRTFDNGSIPHQIHLQEM   419
WP_002279025  357  --DGYAG  YIDG  K  TNQEAFYKYLKGLLNK-I--EGSGYFL--DKIEREDFLRKQRTFDNGSIPHQIHLQEM   419
WP_002279859  357  --DGYAG  YIDG  K  VKQEAFYKYLKNTLNK-I--AGSDYFL--DKIEREDFLRKQRTFDNGSIPHQIHLQEM   419
WP_002280230  357  --DGYAG  YIDG  K  TNQEAFYKYLKGLLNK-I--EGSGYFL--DKIEREDFLRKQRTFDNGSIPHQIHLQEM   419
WP_002281696  357  --DGYAG  YIDG  K  TNQEAFYKYLKGLLNK-I--EGSGYFL--DKIEREDFLRKQRTFDNGSIPHQIHLQEM   419
WP_002282247  357  --NGYAG  YIEN  G  VKQDEFYKYLKNTLSK-I--TGSDYFL--DQIEREDFLRKQRTFDNGSIPHQIHLQEM   419
WP_002282906  357  --DGYAG  YIDG  K  TNQEAFYKYLKGLLNK-I--EGSGYFL--DKIEREDFLRKQRTFDNGSIPHQIHLQEM   419
WP_002283846  357  --DGYAG  YIDG  K  TNQEAFYKYLKGLLNK-I--EGSGYFL--DKIEREDFLRKQRTFDNGSIPHQIHLQEM   419
WP_002287255  357  --DGYAG  YIDG  K  TNQEAFYKYLKGLLNK-I--EGSGYFL--DKIEREDFLRKQRTFDNGSIPHQIHLQEM   419
WP_002288990  357  --DGYAG  YIDG  K  TNQEAFYKYLKGLLNK-I--EGSGYFL--DKIEREDFLRKQRTFDNGSIPHQIHLQEM   419
WP_002289641  357  --DGYAG  YIDG  K  TNQEAFYKYLKGLLNK-I--EGSGYFL--DKIEREDFLRKQRTFDNGSIPHQIHLQEM   419
WP_002290427  357  --DGYAG  YIDG  K  TNQEAFYKYLKGLLNK-I--EGSGYFL--DKIEREDFLRKQRTFDNGSIPHQIHLQEM   419
WP_002295753  357  --DGYAG  YIDG  K  TNQEAFYKYLKGLLNK-I--EGSGYFL--DKIEREDFLRKQRTFDNGSIPHQIHLQEM   419
WP_002296423  357  --DGYAG  YIDG  K  TNQEAFYKYLKGLLNK-I--EGSGYFL--DKIEREDFLRKQRTFDNGSIPHQIHLQEM   419
WP_002304487  357  --NGYAG  YVGA  D  ATEEEFYKYVKGILNK-V--EGADVWL--DKIDREDFLRKQRTFDNGSIPHQIHLQEM   429
WP_002305844  357  --DGYAG  YIDG  K  TNQEAFYKYLKGLLNK-I--EGSGYFL--DKIEREDFLRKQRTFDNGSIPHQIHLQEM   419
WP_002307203  357  --DGYAG  YIDG  K  TNQEAFYKYLKGLLNK-I--EGSGYFL--DKIEREDFLRKQRTFDNGSIPHQIHLQEM   419
WP_002310390  357  --DGYAG  YIDG  K  TNQEAFYKYLKGLLNK-I--EGSGYFL--DKIEREDFLRKQRTFDNGSIPHQIHLQEM   419
WP_002352408  357  --DGYAG  YIDG  K  TNQEAFYKYLKGLLNK-I--EGSGYFL--DKIEREDFLRKQRTFDNGSIPHQIHLQEM   419
WP_012997688  357  --DGYAG  YIDG  K  TNQEAFYKYLKGLLNK-I--EGSGYFL--DKIEREDFLRKQRTFDNGSIPHQIHLQEM   419
WP_014677909  357  --DGYAG  YIDG  K  TNQEAFYKYLKGLLNK-I--EGSGYFL--DKIEREDFLRKQRTFDNGSIPHQIHLQEM   419
WP_019312892  357  --DGYAG  YIDG  K  TNQEAFYKYLKGLLNK-I--EGSGYFL--DKIEREDFLRKQRTFDNGSIPHQIHLQEM   419
WP_019313659  357  --DGYAG  YIDG  K  TNQEAFYKYLKGLLNK-I--EGSGYFL--DKIEREDFLRKQRTFDNGSIPHQIHLQEM   419
WP_019314093  357  --NGYAG  YIDG  K  TNQEAFYKYLKGLLNK-I--EGNGYFL--DKIEREDFLRKQRTFDNGSIPHQIHLQEM   419
WP_019315370  357  --DGYAG  YIDG  K  TNQEAFYKYLKGLLNK-I--EGSGYFL--DKIEREDFLRKQRTFDNGSIPHQIHLQEM   419
WP_019803776  357  --DGYAG  YIDG  K  TNQEAFYKYLKGLLNK-I--EGSGYFL--DKIEREDFLRKQRTFDNGSIPHQIHLQEM   419
WP_019805234  357  --DGYAG  YIDG  K  TNQEAFYKYLKGLLNK-I--EGSGYFL--DKIEREDFLRKQRTFDNGSIPHQIHLQEM   419
WP_024783594  357  --NGYAG  YIEN  G  VKQDEFYKYLKNTLSK-I--TGSDYFL--DQIEREDFLRKQRTFDNGSIPHQIHLQEM   419
WP_024784288  357  --NGYAG  YIEN  G  VKQDEFYKYLKNTLSK-I--TGSDYFL--DQIEREDFLRKQRTFDNGSIPHQIHLQEM   419
WP_024784666  357  --DGYAG  YIDG  K  TNQEAFYKYLKGLLNK-I--EGSGYFL--DKIEREDFLRKQRTFDNGSIPHQIHLQEM   419
```

```
-continued

WP_024784894  357  --DGYAG  YIDG  K  TNQEAFYKYLKGLLNK-I--EGSGYFL--DKIEREDFLRKQRTFDNGSIPHQIHLQEM  419
WP_024786433  357  --NGYAG  YIEN  G  VKQDEFYKYLKNTLSK-I--AGSDYFL--DKIEREDFLRKQRTFDNGSIPHQIHLQEM  419
WP_049473442  357  --DGYAG  YIDG  K  TNQEAFYKYLKGLLNK-I--EGSGYFL--DKIEREDFLRKQRTFDNGSIPHQIHLQEM  419
WP_049474547  357  --DGYAG  YIEG  K  TNQEAFYKYLKGLLNK-I--EGSGYFL--DKIEREDFLRKQRTFDNGSIPHQIHLQEM  419
EMC03581      350  --DGYAG  YIDG  K  TNQEAFYKYLKGLLNK-I--EGSGYFL--DKIEREDFLRKQRTFDNGSIPHQIHLQEM  412
WP_000428612  358  --DGYAG  YIDG  K  TTQESFYKYIKNLLSK-F--EGTDYFL--EKIEREDFLRKQRTFDNGSIPHQIHLQEM  420
WP_000428613  358  --DGYAG  YIDG  K  TTQEGFYKYIKNLLSK-F--EGTDYFL--EKIEREDFLRKQRTFDNGSIPHQIHLQEM  420
WP_049523028  357  --DGYAG  YIDG  K  TTQEAFYKYIKNLISK-I--EGAEYFL--EKIEREDFLRKQRTFDNGSIPHQIHLQEM  419
WP_003107102  326  --NGYAG  YING  K  TSQEDFYKYIKPILSK-L--KGAESLIs--KLEREDFLRKQRTFDNGSIPHQIHLNEL  388
WP_054279288  359  --DGYAG  YISG  K  TSQEAFYKYIKPILET-L--DGAEDFLt--KINREDFLRKQRTFDNGSIPHQIHLQEL  421
WP_049531101  358  --EGYAG  YIDS  K  TSQEAFYKYIKNLLSK-I--DGADYLl--DKIEREDFLRKQRTFDNGSIPHQIHLQEM  420
WP_049538452  358  --DGYAG  YVDG  K  TTQEAFYKYIKNLLSK-F--EGADYFL--EKIEREDFLRKQRTFDNGSIPHQIHLQEM  420
WP_049549711  358  --DGYAG  YIDG  K  TTQEAFYKYIKNLLSK-F--EGTDYFL--NKIEREDFLRKQRTFDNGSIPHQIHLQEM  420
WP_007896501  359  --NGYAG  YIEG  K  VSQEDFYRYIKPILSR-L--KGGDEFLa--KIDRDDFLRKQRTFDNGSIPHQIHLKEL  421
EFR44625      311  --DGYAG  FIDG  K  TTQEAFYRYIKPILSR-L--KGGDEFLa--KIDRDDFLRKQRTFDNGSIPHQIHLKEL  373
WP_028997477  357  --DGYAG  YIDG  K  TTQEAFYKYIKNLLSK-L--EGADYFL--DKIDREDFLRKQRTFDNGSIPHQIHLQEM  419
WP_002906454  358  --DGYAG  YIEG  K  TTQEAFYKYIKNLLSK-F--EGADYFL--DKIEREDFLRKQRTFDNGSIPHQIHLQEM  420
WP_009729476  358  --NGYAG  YIDG  K  TTQETFYKYIKNLLSK-F--EGADYFL--DKIEREDFLRKQRTFDNGSIPHQIHLQEM  420
CQR24647      357  --DGYAG  YIDG  K  TNQEDFYKYLKNLLQK-V--DGGDYFI--EKIEREDFLKQRTFDNGSIPHVHLDEM  419
WP_000066813  358  --DGYAG  YIEG  K  TTQEAFYKYIKNLLSK-F--EGADYFL--DKIEREDFLRKQRTFDNGSIPHQIHLQEM  420
WP_009754323  358  --DGYAG  YIDG  K  TTQEAFYKYIKNLLSK-F--EGADYFL--DKIEREDFLRKQRTFDNGSIPHQIHLQEM  420
WP_044674937  357  --DGYAG  YIEG  K  TTQENFYRFIKKAIEK-I--EGSDYFI--DKIDREDFLRKQRTFDNGSIPHQIHLQEM  419
WP_044676715  357  --DGYAG  YIEG  K  TTQENFYRFIKKAIEK-I--EGSNYFI--DKIDREDFLRKQRTFDNGSIPHQIHLQEM  419
WP_044680361  357  --DGYAG  YIEG  K  TTQENFYRFIKKAIEK-I--EGSNYFI--DKIEREDFLRKQRTFDNGSIPHQIHLQEM  419
WP_044681799  357  --DGYAG  YIEG  K  TTQENFYRFIKKAIEK-I--EGSGYFI--DKIEREDFLRKQRTFDNGSIPHQIHLQEM  419
WP_049533112  357  --KGYAG  YIEN  G  VKQDEFYKYLKGILLQ-I--NGSGDFL--DKIDREDFLRKQRTFDNGSIPHQIHLQEM  419
WP_029090905  316  fYTDYIG  YEES  K  SKEERLFKHIELLLAKeNvlTtVEHAlLeKNITFASLLPLQRSSRNAVIPYQVHEKEL  403
WP_050506696  361  ksKGYYN  YINR  K  APVDEFYKYVKKCIEK-VdtPEAKQILn--DIELENFLLKQNSRTNGSVPYQMQLDEM  429
AIT42264      357  --NGYAG  YIDG  G  ASQEEFYKFIKPILEK-M--DGTEELLv--KLNREDFLRKQRSFYNGVIPYQIHLGEL  419
WP_034440723  363  --NGYAG  YIDG  G  TSQEDFYKFVKAQLKG---eENGEYFL--EAIENENFLRKQRSFYNGVIPYQIHLQEL  425
AKQ21048      357  --NGYAG  YIDG  G  ASQEEFYKFIKPILEK-M--DGTEELLv--DKIEREVFLRKQRSFYNSVIPHQIHLQEM  419
WP_043636532  356  --NGYAG  YIDG  A  TNQEDFYKFIEKVMKT-IksDKKDYFL--DKIEREVFLRKQRSFYNSVIPHQIHLQEM  420
WP_002364836  363  --DGYAG  YIAH  A  VSQLKFYQYVKKIIQD-I--AGAEYFL--EKIAQENFLRKQRTFDNGVIPHQIHLAEL  427
WP_016631044  314  --DGYAG  YIAH  A  VSQLKFYQYVKKIIQD-I--AGAEYFL--EKIAQENFLRKQRTFDNGVIPHQIHLAEL  378
EMS75795      100  --NGYAG  YIDG  A  TTQEDFYKFLKKELNG-I--AGSERFM--EKVDQENFLLKRQRTTANGVIPHQVHLTEL  162
WP_002373311  363  --NGYAG  YIAH  A  VSQLKFYQYVKKIIQD-I--AGAEYFL--EKIAQENFLRKQRTFDNGVIPHQIHLAEL  427
WP_002378009  363  --DGYAG  YITH  A  VSQLKFYQYVKKIIQD-I--AGAEYFL--EKIAQENFLRKQRTFDNGVIPHQIHLAEL  427
WP_002407324  363  --DGYAG  YITH  A  VSQLKFYQYVKKIIQD-I--AGAEYFL--EKIAQENFLRKQRTFDNGVIPHQIHLAEL  427
WP_002413717  365  --DGYAG  YIAH  A  VSQLKFYQYVKKIIQD-I--AGAEYFL--EKIAQENFLRKQRTFDNGVIPHQIHLAEL  429
WP_010775580  363  --DGYAG  YIAH  A  VSQLKFYQYVKKIIQD-I--AGAEYFL--EKIAQENFLRKQRTFDNGVIPHQIHLAEL  427
WP_010818269  363  --DGYAG  YIAH  A  VSQLKFYQYVKKIIQD-I--AGAEYFL--EKIAQENFLRKQRTFDNGVIPHQIHLAEL  427
WP_010824395  363  --DGYAG  YIDG  A  TTQEDFYKFLKKELNG-I--AGSEYFL--EKIAQENFLRKQRTFDNGVIPHQIHLAEL  427
WP_016622645  363  --DGYAG  YIAH  A  ATQEDFYKFVKKELTG-I--RGSEVFL--EKIEQENFLRKQRTFDNGVIPHQIHLSEL  427
WP_033624816  363  --NGYAG  YIAH  A  ATQEDFYKFVKKELTG-I--RGSEVFL--TKIEQENFLRKQRTFDNGVIPHQIHLTEL  427
WP_033625576  361  --DGYAG  YIEG  H  ATQEDFYKFVKKELTG-I--RGSEVFL--TKIEQENFLRKQRTFDNGVIPHQIHLTEL  423
WP_033789179  362  --NGYAG  YIEG  H  ATQEDFYKFVKKELTG-I--RGSEVFL--TKIEQENFLRKQRTFDNGVIPHQIHLTEL  424
WP_002310644  361  --NGYAG  YIEG  H  ATQEDFYKFVKKELTG-I--RGSEVFL--TKIEQENFLRKQRTFDNGVIPHQIHLTEL  423
WP_002312694  362  --NGYAG  YIEG  H  ATQEDFYKFVKKELTG-I--RGSEVFL--TKIEQENFLRKQRTFDNGVIPHQIHLTEL  424
WP_002314015  362  --NGYAG  YIEG  H  ATQEDFYKFVKKELTG-I--RGSEVFL--TKIEQENFLRKQRTFDNGVIPHQIHLTEL  424
WP_002320716  361  --NGYAG  YIEG  H  ATQEDFYKFVKKELTG-I--RGSEVFL--TKIEQENFLRKQRTFDNGVIPHQIHLTEL  423
WP_002330729  362  --NGYAG  YIEG  H  ATQEDFYKFVKKELTG-I--RGSEVFL--TKIEQENFLRKQRTFDNGVIPHQIHLTEL  424
WP_002335161  362  --NGYAG  YIEG  H  ATQEDFYKFVKKELTG-I--RGSEVFL--TKIEQENFLRKQRTFDNGVIPHQIHLTEL  424
WP_002345439  362  --NGYAG  YIEG  H  ATQEDFYKFVKKELTG-I--RGSEVFL--TKIEQENFLRKQRTFDNGVIPHQIHLTEL  424
WP_034867970  355  --NGYAG  YIKG  K  TTQEEFYKFVKKELSG-V--VGSEPFL--EKIDQETFLLKQRTYTNGVIPHQVHLIEL  417
```

-continued

```
WP_047937432  362  --NGYAG  YIEG  H  ATQEDFYKFVKKELTG-I--RGSEVFL--TKIEQENFLRKQRTFDNGVIPHQIHLTEL  424
WP_010720994  355  --NGYAG  YIKG  K  TTQEEFYKFVKKELSG-V--VGSEPFL--EKIDQETFLLKQRTYTNGVIPHQVHLIEL  417
WP_010737004  355  --NGYAG  YIKG  K  TTQEEFYKFVKKELSG-V--VGSEPFL--EKIDQETFLLKQRTYTNGVIPHQVHLIEL  417
WP_034700478  355  --NGYAG  YIKG  K  TTQEEFYKFVKKELSG-V--VGSEPFL--EKIDQETFLLKQRTYTNGVIPHQVHLIEL  417
WP_007209003  359  --NGYAG  YVKG  K  TKEEEFYKYLKTTLVQ---kSGYQYFI--EKIEQENFLRKQRIYDNGVIPHQVHAEEL  421
WP_023519017  355  --NGYAG  YVKG  S  ATQEDFYKFLRTELAG-L--EESQSIM--EKIDLEIYLLKQRTFANGVIPHQIHLVEM  417
WP_010770040  358  --SGYAG  YVEN  S  VTQAEFYKFYYITNLIEK-V--PGAEYFL--EKIEQETFLDKQRTFNNGVIPHQIHLEEL  422
WP_048604708  354  --DGYAG  YIDN  S  TSQEKFYKYITNLIEK-V--DGAEYFL--KKIENEDFLRKQRTFDNGIIPHQIHLEEL  418
WP_010750235  355  --DGYAG  YIDG  K  TTQADFYKFLKKELTG-V--PGSEPML--AKIDQENFLLKQRTPTNGVIPHQVHLTEF  417
AII16583      396  --NGYAG  YIDG  G  ASQEEFYKFKFIKPILEK-M--DGTEELLv--KLNREDLLRKQRTFDNGSIPHQIHLGEL  458
WP_029073316  367  kkNNYCN  YINH  K  TPVDEFYKFKYIKKLIEK-IdaPPDVKTIln--KIELESFMLKQNSRTNGAVPYQMQLDEL  435
WP_031589969  367  kkNNYCN  YINH  K  TPVDEFYKFKYIKKLIEK-IdaPPDVKTIln--KIELESFMLKQNSRTNGAVPYQMQLDEL  435
KDA45870      354  -iSGYAG  YINH  K  VSEEDFYKFYKTKKTLKG-I--PETEEILq--KIDANNYLRKQRTFDNGAIPHQVHLKEL  417
WP_039099354  360  -------  YVDG  K  -SKEDFYGDITKALKNmPdhPIVSEIKk--LIELDQFMPKQRTKDNGAIPHQLHQQEL  425
AKP02966      349  --QAYDD  YINK  K  ---KELYTSLKKFPLKValp--TNLAKEAe--EKISKGTYIVKPRNSENGVPYQLNKIEM  415
WP_010991369  363  --HGYAG  YIDG  -  TKQADFYKFYKMKMTLEN-I--EGADYFI--AKIEKENFLRKQRTFDNGAIPHQLHLEEL  425
WP_033838504  363  --HGYAG  YIDG  -  TKQADFYKFYKMKMTLEN-I--EGADYFI--AKIEKENFLRKQRTFDNGAIPHQLHLEEL  425
EHN60060      366  --HGYAG  YIDG  -  TKQADFYKFYKMKMTLEN-I--EGADYFI--AKIEKENFLRKQRTFDNGAIPHQLHLEEL  428
EFR89594      132  -------  YIDG  -  TKQADFYKFYKMKTTLEN-I--EGADYFI--AKIEKENFLRKQRTFDNGAIPHQLHLEEL  194
WP_038409211  363  --DGYAG  YIDG  -  TTQEKFYKFYKMKMLAN-I--DGADYFI--DQIEEENFLRKQRTFDNGTIPHQLHLEEL  425
EFR95520      1    -------  ----  -  ----MKKMLAN-I--DGADYFI--DQIEEENFLRKQRTFDNGTIPHQLHLEEL  44
WP_003723650  363  --DGYAG  YIDG  -  TKQVDFYKFYLKLKTILEN-I--EGSDYFI--AKIEEENFLRKQRTFDNGAIPHQLHLEEL  425
WP_003727705  363  --DGYAG  YIDG  -  TKQVDFYKFYLKLKTILEN-V--EGADYFI--TKIEEENFLRKQRTFDNGVIPHQLHLGEL  425
WP_003730785  363  --DGYAG  YIDG  -  TKQVDFYKFYLKLKTILEN-I--EGADYFI--AKIEEENFLRKQRTFDNGAIPHQLHLEEL  425
WP_003733029  363  --HGYAG  YISG  -  TKQADFYKFYKMKATLEK-I--EGADYFI--AKIEEENFLRKQRTFDNGAIPHQLHLEEL  425
WP_003739838  363  --DGYAG  YIDG  -  TKQVDFYKFYKMKLTLEN-I--EGADYFI--AKIEEENFLRKQRTFDNGAIPHQLHLEEL  425
WP_014601172  363  --DGYAG  YIDG  -  TKQVDFYKFYLKLKTILEN-I--EGADYFI--AKIEEENFLRKQRTFDNGAIPHQLHLEEL  425
WP_023548323  363  --DGYAG  YIDG  -  TKQVDFYKFYLKLKTILEN-V--EGSDYFI--TKIEEENFLRKQRTFDNGAIPHQLHLEEL  425
WP_031665337  363  --DGYAG  YIDG  -  TKQVDFYKFYLKLKTILEN-I--EGSDYFI--AKIEEENFLRKQRTFDNGAIPHQLHLEEL  425
WP_031669209  363  --HGYAG  YISG  -  TKQADFYKFYKMKATLEK-I--EGADYFI--AKIEEENFLRKQRTFDNGAIPHQLHLEEL  425
WP_033920898  363  --DGYAG  YIDG  -  TKQVDFYKFYLKLKTILEN-I--EGADYFI--AKIEEENFLRKQRTFDNGAIPHQLHLEEL  425
AKI42028      366  --DGYAG  YIDG  -  TKQVDFYKFYLKLKTILEN-I--EGADYFI--AKIEEENFLRKQRTFDNGAIPHQLHLEEL  428
AKI50529      366  -------  ----  -  TKQVDFYKFYLKLKTILEN-I--EGADYFI--AKIEEENFLRKQRTFDNGAIPHQLHLEEL  428
EFR83390      -    -------  ----  -  ---------------------  ------  -----------------------------  -
WP_046323366  363  --DGYAG  YIEG  G  ASQEEFYKFKFIKPILEK-V--EGADYFI--NQIEEENFLRKQRTFDNGSIPHQLHLGEL  425
AKE81011      373  --NGYAG  YIDG  G  ASQEEFYKFKFIKPILEK-M--DGTEELLv--KLNREDLLRKQRTFDNGSIPHQIHLGEL  435
CUO82355      365  kvKGYYN  YINR  K  APVDEFYKFVKKCIEK-Vdt PEAKQIlh--DIELENFLLKQNRTNGSVPYQMQLDEM  433
WP_033162887  366  klhNYLG  YIKY  D  TPVEEFYKYIKGLLAK-VdtDEAREIle--RIDLEKFMLKQNSRTNGSIPYQMQKDEM  434
AGZ01981      390  --NGYAG  YIDG  G  ASQEEFYKFKFIKPILEK-M--DGTEELLv--KLNREDLLRKQRTFDNGSIPHQIHLGEL  452
AKA60242      357  --NGYAG  YIDG  G  ASQEEFYKFKFIKPILEK-M--DGTEELLv--KLNREDLLRKQRTFDNGSIPHQIHLGEL  419
AKS40380      361  --NGYAG  YIDG  G  ASQEEFYKFKFIKPILEK-M--DGTEELLv--KLNREDLLRKQRTFDNGSIPHQIHLGEL  423
4UN5_B        -    --HGYAG  YIDG  G  ASQEEFYKFKFIKPILEK-M--DGTEELLv--KLNREDLLRKQRTFDNGSIPHQIHLGEL  -

WP_010922251  420  HAILRRQEDFYPFLKD--NRE  KIEKILTFRIPYYVGPL  ARG-n-SRFAWMTR---KSEETITPWNF[E]VDKGA  486

WP_039695303  423  HAILRRQGDFYPFLKE--KQD  RIEKILTFRIPYYVGPL  VRKD--SRFAWAEY---RSDEKITPWNFDKVIDKEK  489
WP_045635197  420  NAILRRQGEYYPFLKD--NKE  KIEKILTFRIPYYVGPL  ARGN--RDFAWLTR---NSDEAIRPWNFEEIVDKAS  486
5AXW_A        184  KQLLKVQKAYHQLDQSfi-D   TYIDLLETRRTYYEGPG  ---Eg-SPFGWKDI-----------------------  229
WP_009880683  104  HAILRRQEDFYPFLKD--NRE  KIEKILTFRIPYYVGPL  ARG-n-SRFAWMTR---KSEETITPWNFEEVVDKGA  170
WP_010922251  420  HAILRRQEDFYPFLKD--NRE  KIEKILTFRIPYYVGPL  ARG-n-SRFAWMTR---KSEETITPWNFEEVVDKGA  486
WP_011054416  420  HAILRRQEDFYPFLKD--NRE  KIEKILTFRIPYYVGPL  ARG-n-SRFAWMTR---KSEETITPWNFEEVVDKGA  486
WP_011284745  420  HAILRRQEDFYPFLKD--NRE  KIEKILTFRIPYYVGPL  ARG-n-SRFAWMTR---KSEETITPWNFEEVVDKGA  486
WP_011285506  420  HAILRRQEDFYPFLKD--NRE  KIEKILTFRIPYYVGPL  ARG-n-SRFAWMTR---KSEETITPWNFEEVVDKGA  486
WP_015277619  420  HAILRRQEDFYPFLKD--NRE  KIEKILTFRIPYYVGPL  ARG-n-SRFAWMTR---KSEETITPWNFEEVVDKGA  486
```

-continued

| | | | | | |
|---|---|---|---|---|---|
| WP_012560673 | 420 | HAILRRQEDFYPFLKD-NRE | KIEKILTFRIPYYVGPL | ARG-n-SRFAWMTR---KSEETITPWNFEEVVDKGA | 486 |
| WP_014407541 | 420 | HAILRRQEDFYPFLKD-NRE | KIEKILTFRIPYYVGPL | ARG-n-SRFAWMTR---KSEETITPWNFEEVVDKGA | 486 |
| WP_020905136 | 420 | HAILRRQEDFYPFLKD-NRE | KIEKILTFRIPYYVGPL | ARG-n-SRFAWMTR---KSEETITPWNFEEVVDKGA | 486 |
| WP_023080005 | 420 | HAILRRQEDFYPFLKD-NRE | KIEKILTFRIPYYVGPL | ARG-n-SRFAWMTR---KSEETITPWNFEEVVDKGA | 486 |
| WP_023610282 | 420 | HAILRRQEDFYPFLKD-NRE | KIEKILTFRIPYYVGPL | ARG-n-SRFAWMTR---KSEETITPWNFEEVVDKGA | 486 |
| WP_030125963 | 420 | HAILRRQEDFYPFLKD-NRE | KIEKILTFRIPYYVGPL | ARG-n-SRFAWMTR---KSEETITPWNFEEVVDKGA | 486 |
| WP_030126706 | 420 | HAILRRQEDFYPFLKD-NRE | KIEKILTFRIPYYVGPL | ARG-n-SRFAWMTR---KSEETITPWNFEEVVDKGA | 486 |
| WP_031488318 | 420 | HAILRRQEDFYPFLKD-NRE | KIEKILTFRIPYYVGPL | ARG-n-SRFAWMTR---KSEETITPWNFEEVVDKGA | 486 |
| WP_032460140 | 420 | HAILRRQEDFYPFLKD-NRE | KIEKILTFRIPYYVGPL | ARG-n-SRFAWMTR---KSEETITPWNFEEVVDKGA | 486 |
| WP_032461047 | 420 | HAILRRQEDFYPFLKD-NRE | KIEKILTFRIPYYVGPL | ARG-n-SRFAWMTR---KSEETITPWNFEEVVDKGA | 486 |
| WP_032462016 | 420 | HAILRRQEDFYPFLKD-NRE | KIEKILTFRIPYYVGPL | ARG-n-SRFAWMTR---KSEETITPWNFEEVVDKGA | 486 |
| WP_032462936 | 420 | HAILRRQEDFYPFLKD-NRE | KIEKILTFRIPYYVGPL | ARG-n-SRFAWMTR---KSEETITPWNFEEVVDKGA | 486 |
| WP_032464890 | 420 | HAILRRQEDFYPFLKD-NRE | KIEKILTFRIPYYVGPL | ARG-n-SRFAWMTR---KSEETITPWNFEEVVDKGA | 486 |
| WP_033888930 | 245 | HAILRRQEDFYPFLKD-NRE | KIEKILTFRIPYYVGPL | ARG-n-SRFAWMTR---KSEETITPWNFEEVVDKGA | 311 |
| WP_038431314 | 420 | HAILRRQEDFYPFLKD-NRE | KIEKILTFRIPYYVGPL | ARG-n-SRFAWMTR---KSEETITPWNFEEVVDKGA | 486 |
| WP_038432938 | 420 | HAILRRQEDFYPFLKD-NRE | KIEKILTFRIPYYVGPL | ARG-n-SRFAWMTR---KSEETITPWNFEEVVDKGA | 486 |
| WP_038434062 | 331 | HAILRRQEDFYPFLKD-NRE | KIEKILTFRIPYYVGPL | ARG-n-SRFAWMTR---KSEETITPWNFEEVVDKGA | 397 |
| BAQ51233 | | ------------------- | ----------------- | ------------------------------------ | |
| KGE60856 | | ------------------- | ----------------- | ------------------------------------ | |
| KGE60162 | 420 | HAILRRQEDFYPFLKD-NRE | KIEKILTFRIPYYVGPL | ARG-n-SRFAWMTR---KSEETITPWNFEEVVDKGA | 486 |
| WP_002989955 | 420 | HAILRRQEEHYPFLKE-NQD | KIEKILTFRIPYYVGPL | ARKG-SRFAWAEY---KADEKITPWNFDDILDKEK | 486 |
| WP_003030002 | 423 | HAILRRQGDYPFLKE-NQD | KIEKILTFRIPYYVGPL | ARKD-SRFSWAEY---HSDEKITPWNFDKVIDKEK | 489 |
| WP_003065552 | 421 | RAIIRRQSEYYPFLKE-NLD | RIEKILTFRIPYYIGPL | AREK-SDFAWMTR---KTDDSIRPWNFEDLVDKEK | 487 |
| WP_001040076 | 421 | KAIIRRQSEYYPFLKE-NQD | KIEKILTFRIPYYVGPL | AREK-SDFAWMTR---KTDDSIRPWNFEDLVDKEK | 487 |
| WP_001040080 | 421 | KAIIRRQSEYYPFLKE-NQD | KIEKILTFRIPYYVGPL | AREK-SDFAWMTR---KTDDSIRPWNFEDLVDKEK | 487 |
| WP_001040081 | 421 | KAIIRRQSEYYPFLKE-NQD | KIEKILTFRIPYYVGPL | AREK-SDFAWMTR---KTDDSIRPWNFEDLVDKEK | 487 |
| WP_001040083 | 421 | KAIIRRQSEYYPFLKE-NQD | KIEKILTFRIPYYVGPL | AREK-SDFAWMTR---KTDDSIRPWNFEDLVDKEK | 487 |
| WP_001040085 | 421 | KAIIRRQSEYYPFLKE-NQD | KIEKILTFRIPYYVGPL | AREK-SDFAWMTR---KTDDSIRPWNFEDLVDKEK | 487 |
| WP_001040087 | 421 | KAIIRRQSEYYPFLKE-NQD | KIEKILTFRIPYYVGPL | AREK-SDFAWMTR---KTDDSIRPWNFEDLVDKEK | 487 |
| WP_001040088 | 421 | KAIIRRQSEYYPFLKE-NQD | KIEKILTFRIPYYVGPL | ARGN-SDFAWMTR---KTDDSIRPWNFEDLVDKEK | 487 |
| WP_001040089 | 421 | KAIIRRQSEYYPFLKE-NQD | KIEKILTFRIPYYVGPL | AREK-SDFAWMTR---KTDDSIRPWNFEDLVDKEK | 487 |
| WP_001040091 | 421 | KAIIRRQSEYYPFLKE-NQD | KIEKILTFRIPYYVGPL | AREK-SDFAWMTR---KTDDSIRPWNFEDLVDKEK | 487 |
| WP_001040092 | 421 | KAIIRRQSEYYPFLKE-NLD | KIEKILTFRIPYYVGPL | AREK-SDFAWMTR---KTDDSIRPWNFEDLVDKEK | 487 |
| WP_001040094 | 421 | RAIIRRQSEYYPFLKE-NLD | RIEKILTFRIPYYIGPL | AREK-SDFAWMTR---KTDDSIRPWNFEDLVDKEK | 487 |
| WP_001040095 | 421 | RAIIRRQSEYYPFLKE-NLD | RIEKILTFRIPYYIGPL | AREK-SDFAWMTR---KTDDSIRPWNFEDLVDKEK | 487 |
| WP_001040096 | 421 | RAIIRRQSEYYPFLKE-NLD | RIEKILTFRIPYYIGPL | AREK-SDFAWMTR---KTDDSIRPWNFEDLVDKEK | 487 |
| WP_001040097 | 421 | RAIIRRQSEYYPFLKE-NLD | RIEKILTFRIPYYIGPL | AREK-SDFAWMTR---KTDDSIRPWNFEDLVDKEK | 487 |
| WP_001040098 | 421 | KAIIRRQSEYYPFLKE-NLD | RIEKILTFRIPYYIGPL | AREK-SDFAWMTR---KTDDSIRPWNFEDLVDKEK | 487 |
| WP_001040099 | 421 | RAIIRRQSEYYPFLKE-NLD | RIEKILTFRIPYYIGPL | AREK-SDFAWMTR---KTDDSIRPWNFEDLVDKEK | 487 |
| WP_001040100 | 421 | KAIIRRQSEYYPFLLKE-NLD | RIEKILTFRIPYYIGPL | AREK-SDFAWMTR---KTDDSIRPWNFEDLVDKEK | 487 |
| WP_001040104 | 421 | RAIIRRQSEYYPFLKE-NLD | RIEKILTFRIPYYIGPL | AREK-SDFAWMTR---KTDDSIRPWNFEDLVDKEK | 487 |
| WP_001040105 | 421 | KAIIRRQSEYYPFLKE-NLD | RIEKILTFRIPYYIGPL | AREK-SDFAWMTR---KTDDSIRPWNFEDLVDKEK | 487 |
| WP_001040106 | 421 | RAIIRRQSEYYPFLKE-NLD | RIEKILTFRIPYYIGPL | AREK-SDFAWMTR---KTDDSIRPWNFEDLVDKEA | 487 |
| WP_001040107 | 421 | KAIIRRQSEYYPFLKE-NLD | RIEKILTFRIPYYIGPL | AREK-SDFAWMTR---KTDDSIRPWNFEELVDKEA | 487 |
| WP_001040108 | 421 | KAIIRRQSEYYPFLKE-NLD | RIEKILTFRIPYYIGPL | AREK-SDFAWMTR---KTDDSIRPWNFEELVDKEA | 487 |
| WP_001040109 | 421 | KAIIRRQSEYYPFLKE-NQD | KIEKILTFRIPYYVGPL | AREK-SDFAWMTR---KTDDSIRPWNFEELVDKEA | 487 |
| WP_001040110 | 421 | KAIIRRQSEYYPFLKE-NLD | RIEKILTFRIPYYIGPL | ARGN-SDFAWMTR---KTDDSIRPWNFEELVDKEA | 487 |
| WP_015058523 | 421 | RAIIRRQSEYYPFLKE-NLD | RIEKILTFRIPYYIGPL | AREK-SDFAWMTR---KTDDSIRPWNFEELVDKEA | 487 |
| WP_017643650 | 421 | KAIIRRQSEYYPFLKE-NLD | RIEKILTFRIPYYVGPL | AREK-SDFAWMTR---KTDDSIRPWNFEELVDKEA | 487 |
| WP_017647151 | 421 | KAIIRRQSEYYPFLKE-NLD | RIEKILTFRIPYYVGPL | AREK-SDFAWMTR---KTDDSIRPWNFEELVDKEA | 487 |
| WP_017648376 | 421 | RAIIRRQSEYYPFLKE-NLD | RIEKILTFRIPYYVGPL | AREK-SDFAWMTR---KTDDSIRPWNFEELVDKEA | 487 |
| WP_017649527 | 421 | KAIIRRQSEYYPFLKE-NQD | RIEKILTFRIPYYVGPL | AREK-SDFAWMTR---KTDDSIRPWNFEELVDKEK | 487 |

-continued

| | | | | | |
|---|---|---|---|---|---|
| WP_017771611 | 421 | KAIIRRQSEYYPFLKE-NLD | RIEKILTFRIPYYIGPL | AREK--SDFAWMTR---KTDDSIRPWNFEELVDKEA | 487 |
| WP_017771984 | 421 | KAIIRRQSEYYPFLKE-NQD | RIEKILTFRIPYYIGPL | AREK--SDFAWMTR---KTDDSIRPWNFEDLVDKEK | 487 |
| CFQ25032 | 421 | KAIIRRQSEYYPFLKE-NQD | RIEKILTFRIPYYIGPL | AREK--SDFAWMTR---KTDDSIRPWNFEDLVDKEK | 487 |
| CFV16040 | 421 | KAIIRRQSEYYPFLKE-NQD | RIEKILTFRIPYYIGPL | AREK--SDFAWMTR---KTDDSIRPWNFEDLVDKEK | 487 |
| KLJ37842 | 421 | KAIIRRQSEYYPFLKE-NQD | RIEKILTFRIPYYIGPL | AREK--SDFAWMTR---KTDDSIRPWNFEDLVDKEK | 487 |
| KLJ72361 | 421 | KAIIRRQSEYYPFLKE-NQD | RIEKILTFRIPYYIGPL | AREK--SDFAWMTR---KTDDSIRPWNFEDLVDKEK | 487 |
| KLL20707 | 421 | KAIIRRQSEYYPFLKE-NQD | RIEKILTFRIPYYIGPL | AREK--SDFAWMTR---KTDDSIRPWNFEDLVDKEK | 487 |
| KLL42645 | 421 | KAIIRRQSEYYPFLKE-NLD | RIEKILTFRIPYYIGPL | AREK--SDFAWMTR---KTDDSIRPWNFEDLVDKEA | 487 |
| WP_047207273 | 421 | RAIIRRQSEYYPFLKE-NQD | RIEKILTFRIPYYIGPL | AREK--SDFAWMTR---KTDDSIRPWNFEDLVDKEK | 487 |
| WP_047209694 | 421 | KAIIRRQSEYYPFLKE-NQD | RIEKILTFRIPYYIGPL | AREK--SDFAWMTR---KTDDSIRPWNFEDLVDKEK | 487 |
| WP_050198062 | 421 | KAIIRRQSEYYPFLKE-NQD | RIEKILTFRIPYYIGPL | AREK--SDFAWMTR---KTDDSIRPWNFEDLVDKEK | 487 |
| WP_050201642 | 421 | KAIIRRQSEYYPFLKE-NQD | RIEKILTFRIPYYIGPL | AREK--SDFAWMTR---KTDDSIRPWNFEDLVDKEK | 487 |
| WP_050204027 | 421 | KAIIRRQSEYYPFLKE-NLD | RIEKILTFRIPYYIGPL | AREK--SDFAWMTR---KTDDSIRPWNFEELVDKEA | 487 |
| WP_050881965 | 421 | KAIIRRQSEYYPFLKE-NQD | RIEKILTFRIPYYIGPL | AREK--SDFAWMTR---KTDDSIRPWNFEDLVDKEK | 487 |
| WP_050886065 | 421 | KDIIRRQSEYYPFLKE-NQD | RIEKILTFRIPYYIGPL | AREK--SDFAWMTR---KTDDSIRPWNFEDLVDKEK | 487 |
| AHN30376 | 421 | KAIIRRQSEYYPFLKE-NQD | RIEKILTFRIPYYIGPL | ARGN--SDFAWMTR---KTDDSIRPWNFEDLVDKEK | 487 |
| EAO78426 | 421 | KAIIRRQSEYYPFLKE-NQD | RIEKILTFRIPYYIGPL | AREK--SDFAWMTR---KTDDSIRPWNFEDLVDKEK | 487 |
| CCW42055 | 421 | RAIIRRQSEYYPFLKE-NLD | RIEKILTFRIPYYVGPL | AREK--SDFAWMTR---KTDDSIRPWNFEELVDKEA | 487 |
| WP_003041502 | 420 | HAILRRQGEHYPFLKE-NQD | RIEKILTFRIPYYVGPL | ARKG--SRFAWAEY---KADEKITPWNFDDILDKEK | 486 |
| WP_037593752 | 421 | HAILRRQGEHYPFLKE-NQD | RIEKILTFRIPYYVGPL | ARKG--SRFAWAEY---KADEKITPWNFDDILDKEK | 487 |
| WP_049516684 | 421 | HAILRRQGEHYPFLKE-NQD | RIEKILTFRIPYYVGPL | ARKG--SRFAWAEY---KADEKITPWNFDDILDKEK | 487 |
| GAD46167 | 420 | HAILRRQGEHYPFLKE-NQD | EIEKILTFRIPYYVGPL | ARKG--SRFAWAEY---KADEKITPWNFDDILDKEK | 486 |
| WP_018363470 | 421 | HAILRRQEEFYPFLKE-NQE | RIEKILTFRIPYYVGPL | ARKD--SRFAWMTR---RSDEKITPWNFDKVIDKEK | 487 |
| WP_003043819 | 430 | HAILRRQGEHYPFLKE-NRE | RIEKILTFRIPYYVGPL | ARG-n-SRFEAITPWNFEEVVDKGA | 496 |
| WP_006269658 | 420 | HAILRRQGDFYPFLKE-NQD | RIEKILTFRIPYYVGPL | ARKG--SRFAWMTR---KADEKITPWNFEEVVDKGA | 486 |
| WP_048800889 | 420 | HAILRRQGEHYPFLKE-NQD | RIEKILTFRIPYYVGPL | ARKG--SRFAWMTR---KADEKITPWNFDDILDKEK | 486 |
| WP_012767106 | 420 | HAILRRQEDFYPFLKD-NRE | RIEKILTFRIPYYVGPL | VRKG--SRFAWMTR---KSEETITPWNFEEVVDKGA | 486 |
| WP_014612333 | 420 | HAILRRQEDFYPFLKD-NRE | RIEKILTFRIPYYVGPL | ARG-n-SRFAWMTR---KSEETITPWNFEEVVDKGA | 486 |
| WP_015017095 | 420 | HAILRRQEDFYPFLKD-NRE | RIEKILTFRIPYYVGPL | ARG-n-SRFAWMTR---KSEETITPWNFDKVIDKEK | 486 |
| WP_015057649 | 420 | HAILRRQEDFYPFLKD-NRE | RIEKILTFRIPYYVGPL | ARG-n-SRFAWMTR---KSEETITPWNFEEVVDKGA | 486 |
| WP_048272215 | 420 | HAILRRQEDFYPFLKD-NRE | RIEKILTFRIPYYVGPL | ARG-n-SRFAWMTR---KSEETITPWNFEEVVDKGA | 486 |
| WP_049519324 | 420 | HAILRRQEVEYPFLKD-NRK | RIEKILTFRIPYYVGPL | ARG-h-SRFAWMTR---KPDGAIRPWNFEEVVDEEA | 486 |
| WP_012515931 | 420 | HAILRRQEVEYPFLKD-NRK | KIESLLTFRIPYYVGPL | ARG-h-SRFAWVKR---KPDGAIRPWNFEEIVDEEA | 486 |
| WP_021320964 | 420 | RTILRRQEVEYPFLKE-NQA | KIESLLTFRIPYYVGPL | ARKN--SRFAWAKY---KPDEPITPWNFDEVVDKEK | 486 |
| WP_037581760 | 420 | HAILRRQGDYYPFLKE-KQD | RIEKILTFRIPYYVGPL | ARKN--SRFAWAEY---HSDEPITPWNFDKVIDKEK | 486 |
| WP_004232481 | 420 | HAILRRQGEHYAFLKE-NQA | RIEKILTFRIPYYVGPL | VRKD--SRFAWAEY---HSDEKITPWNFDEIIDKEK | 486 |
| WP_009854540 | 421 | HAILRRQGDYYPFLKD-KQD | RIEKILTFRIPYYVGPL | ARKN--SRFAWAEY---HSDEPITPWNFDEVVDKEK | 487 |
| WP_012962174 | 423 | HAILRRQGEHYAFLKE-NQA | RIEKILTFRIPYYVGPL | ARKN--SRFAWAEY---HSDEKITPWNFDEIIDKEK | 489 |
| WP_039695303 | 420 | HAILRRQGDYYPFLKE-KQD | RIEKILTFRIPYYVGPL | VRKD--SRFAWAEY---RSDEKITPWNFDKVIDKEK | 486 |
| WP_014334983 | 420 | HSILRRQGDYYPFLKE-NQA | RIEKILTFRIPYYVGPL | ARKD--SRFAWANY---HSDEPITPWNFDEVVDKEK | 486 |
| WP_003099269 | 420 | KAIIRRQEKEYPFLKE-NQK | RIEKILTFRIPYYVGPL | ANG-q-SSFAWLKR---QSNESITPWNFEEVVDQEA | 486 |
| AHY15608 | 420 | KAIIRRQEKEYPFLKE-NQK | RIEKILTFRIPYYVGPL | ANG-q-SSFAWLKR---QSNESITPWNFEEVVDQEA | 486 |
| AHY17476 | | | | | |
| ESR09100 | | | | | |
| AGM98575 | 420 | KAIIRRQEKEYPFLKE-NQK | RIEKILTFRIPYYVGPL | ANG-q-SSFAWLKR---QSNESITPWNFEEVVDQEA | 486 |
| ALF27331 | 420 | RAIIRRQAEFYPFLAD-NQD | RIEKILTFRIPYYIGPL | ARGK--SDFSWLSR---KSADKITPWNFDEIVDKES | 486 |
| WP_018372492 | 433 | QAIILNQSKYYPFLAE-NKE | RIEKILTFRIPYYIGPL | ARGN--SSFAWLQR---KSDEAIRPWNFEQVVDMET | 499 |
| WP_045618028 | 421 | NAILRRQGEHYPFLQE-NKE | RIEKILTFRIPYYVGPL | ARGN--RDFAWLTR---NSDQAIRPWNFEEIVDKAS | 487 |
| WP_045635197 | 420 | RAIIRRQAEFYPFLAD-NKE | RIEKILTFRIPYYVGPL | ARGN--SDFAIRPWNFEEIVDKAS | 486 |
| WP_002263549 | 420 | HAILRRQGDYYPFLKE-NQD | RIEKLLTFTFKIPYYVGPL | ARKD--SDFAWLSR---KSADKITPWNFDEIVDKES | 486 |
| WP_002263887 | 420 | KAIIRRQEKEYPFLKE-NQK | RIEKLLTFTFKIPYYVGPL | ARGK--SDFAWLSR---KSADKITPWNFDEIVDKES | 486 |
| WP_002269043 | 420 | RAIIRRQAEFYPFLAD-NQD | RIEKILTFRIPYYVGPL | ARGK--SDFAWLSR---KSADKITPWNFDEIVDKES | 486 |
| WP_002269448 | 420 | RAIIRRQAEFYPFLKD-NQD | RIEKILTFRIPYYVGPL | ARGK--SDFAWLSR---KSADKITPWNFDEIVDKES | 486 |

-continued

| | | | | | |
|---|---|---|---|---|---|
| WP_002271977 | 420 | RAIIRRQAEFYPFLAD-NQD | RIEKILTFRIPYYVGPL | ARGK--SDFAWLSR---KSADKITPWNFDEIVDKES | 486 |
| WP_002272766 | 420 | RAIIRRQAEFYPFLAD-NQD | RIEKILTFRIPYYVGPL | ARGK--SDFAWLSR---KSADKITPWNFDEIVDKES | 486 |
| WP_002273241 | 420 | RAIIRRQAEFYPFLAD-NQD | RIEKILTFRIPYYVGPL | ARGK--SDFAWLSR---KSADKITPWNFDEIVDKES | 486 |
| WP_002275430 | 420 | RAIIRRQAEFYPFLAD-NQD | RIEKILTFRIPYYVGPL | ARGK--SDFAWLSR---KSADKITPWNFDEIVDKES | 486 |
| WP_002276448 | 420 | RAIIRRQAEFYPFLAD-NQD | RIEKILTFRIPYYVGPL | ARGK--SRFAWAEY---HSDEAVMPWNFDQVIDKES | 486 |
| WP_002277050 | 420 | HAILRRQGDYYPFLKE-NQD | RIEKILTFRIPYYVGPL | ARKN--SRFAWAEY---HSDEAVMPWNFDQVIDKES | 486 |
| WP_002277364 | 420 | RAIIRRQSEFYPFLAD-NQD | RIEKILTFRIPYYVGPL | ARGK--SDFAWLSR---KSADKITPWNFDEIVDKES | 486 |
| WP_002279025 | 420 | RAIIRRQAEFYPFLAD-NQD | RIEKILTFRIPYYVGPL | ASGK--SDFAWLSR---KSADKITPWNFDEIVDKES | 486 |
| WP_002279859 | 420 | RAIIRRQAEFYPFLAD-NQD | RIEKILTFRIPYYVGPL | ARGK--SDFAWLSR---KSADKITPWNFDEIVDKES | 486 |
| WP_002280230 | 420 | RAIIRRQAEFYPFLAD-NQD | RIEKILTFRIPYYVGPL | ARGK--SDFAWLSR---KSADKITPWNFDEIVDKES | 486 |
| WP_002281696 | 420 | RAIIRRQAEFYPFLAD-NQD | RIEKILTFRIPYYVGPL | ARGK--SDFAWLSR---KSADKITPWNFDEIVDKES | 486 |
| WP_002282247 | 420 | HAILRRQGDYYPFLKE-NQD | RIEKILTFRIPYYVGPL | ARKN--SRFAWAEY---HSDEAVTPWNFDQVIDKES | 486 |
| WP_002282906 | 420 | RAIIRRQAEFYPFLAD-NQD | RIEKILTFRIPYYVGPL | ARKN--SRFAWAEY---KSADKITPWNFDEIVDKES | 486 |
| WP_002283846 | 420 | RAIIRRQAEFYPFLAD-NOD | RIEKILTFRIPYYVGPL | ARGK--SDFAWLSR---KSADKITPWNFDEIVDKES | 486 |
| WP_002287255 | 420 | RAIIRRQAEFYPFLAD-NQD | RIEKILTFRIPYYVGPL | ARGK--SDFAWLSR---KSADKITPWNFDEIVDKES | 486 |
| WP_002288990 | 420 | RAIIRRQAEFYPFLAD-NQD | RIEKILTFRIPYYVGPL | ARGK--SDFAWLSR---KSADKITPWNFDEIVDKES | 486 |
| WP_002289641 | 420 | RAIIRRQAEFYPFLAD-NQD | RIEKILTFRIPYYVGPL | ASGK--SDFAWLSR---KSADKITPWNFDEIVDKES | 486 |
| WP_002290427 | 420 | RAIIRRQAEFYPFLAD-NQD | RIEKILTFRIPYYVGPL | ARGK--SDFAWLSR---KSADKITPWNFDEIVDKES | 486 |
| WP_002295753 | 420 | RAIIRRQAEFYPFLAD-NQD | RIEKILTFRIPYYVGPL | ARGK--SDFAWLSR---KSADKITPWNFDEIVDKES | 486 |
| WP_002296423 | 420 | RAIIRRQAEFYPFLAD-NQD | RIEKILTFRIPYYVGPL | ARGK--SDFAWLSR---KSADKITPWNFDEIVDKES | 486 |
| WP_002304487 | 430 | HAILRRQGEHYPFLKE-NQD | KIEKLLTFRIPYYVGPL | VRKG--SRFAWAEY---KADEKITPWNFDDILDKEK | 496 |
| WP_002305844 | 420 | RAIIRRQAEFYPFLAD-NQD | RIEKILTFRIPYYVGPL | ARGK--SDFAWLSR---KSADKITPWNFDEIVDKES | 486 |
| WP_002307203 | 420 | RAIIRRQAEFYPFLAD-NQD | RIEKILTFRIPYYVGPL | ARGK--SDFAWLSR---KSADKITPWNFDEIVDKES | 486 |
| WP_002310390 | 420 | RAIIRRQAEFYPFLAD-NQD | RIEKILTFRIPYYVGPL | ARGK--SDFAWLSR---KSADKITPWNFDEIVDKES | 486 |
| WP_002352408 | 420 | RAIIRRQAEFYPFLAD-NQD | RIEKILTFRIPYYVGPL | ARGK--SDFAWLSR---KSADKITPWNFDEIVDKES | 486 |
| WP_012997688 | 420 | RAIIRRQAEFYPFLAD-NQD | RIEKILTFRIPYYVGPL | ARGK--SDFAWLSR---KSADKITPWNFDEIVDKES | 486 |
| WP_014677909 | 420 | RAIIRRQAEFYPFLAD-NQD | RIEKILTFRIPYYVGPL | ARGK--SDFAWLSR---KSADKITPWNFDEIVDKES | 486 |
| WP_019312892 | 420 | RAIIRRQAEFYPFLAD-NQD | RIEKILTFRIPYYVGPL | ARGK--SDFAWLSR---KSADKITPWNFDEIVDKES | 486 |
| WP_019313659 | 420 | RAIIRRQAEFYPFLAD-NQD | RIEKILTFRIPYYVGPL | ARGK--SDFAWLSR---KSADKITPWNFDEIVDKES | 486 |
| WP_019314093 | 420 | RAIIRRQAEFYPFLAD-NQD | RIEKILTFRIPYYVGPL | ARKN--SRFAWAEY---HSDEAVTPWNFDQVIDKES | 486 |
| WP_019315370 | 420 | HAILRRQGDYYPFLKE-NQD | RIEKILTFRIPYYVGPL | ARGK--SDFAWLSR---KSADKITPWNFDEIVDKES | 486 |
| WP_019803776 | 420 | RAIIRRQAEFYPFLAD-NQD | RIEKILTFRIPYYVGPL | ARGK--SDFAWLSR---KSADKITPWNFDEIVDKES | 486 |
| WP_019805234 | 420 | RAIIRRQAEFYPFLAD-NQD | RIEKILTFRIPYYVGPL | ASGK--SDFAWLSR---KSADKITPWNFDEIVDKES | 486 |
| WP_024783594 | 420 | RAIIRRQAEFYPFLAD-NQD | RIEKILTFRIPYYVGPL | ARKN--SRFAWAEY---HSDEAVTPWNFDQVIDKES | 486 |
| WP_024784288 | 420 | HAILRRQGDYYPFLKE-NQD | RIEKILTFRIPYYVGPL | ARGK--SDFAWLSR---KSADKITPWNFDEIVDKES | 486 |
| WP_024784666 | 420 | RAIIRRQAEFYPFLAD-NQD | RIEKILTFRIPYYVGPL | ARGK--SDFAWLSR---KSADKITPWNFDEIVDKES | 486 |
| WP_024784894 | 420 | RAIIRRQAEFYPFLAD-NQD | RIEKILTFRIPYYVGPL | ASGK--SDFAWLSR---KSADKITPWNFDEIVDKES | 486 |
| WP_024786433 | 420 | HAILRRQGDYYPFLKE-NQD | RIEKILTFRIPYYVGPL | ARKN--SRFAWAEY---HSDEAVTPWNFDQVIDKES | 486 |
| WP_049473442 | 420 | RAIIRRQAEFYPFLAD-NQD | RIEKILTFRIPYYVGPL | ASGK--SDFAWLSR---KSADKITPWNFDEIVDKES | 486 |
| WP_049474547 | 420 | RAIIRRQAEFYPFLAD-NQD | RIEKILTFRIPYYVGPL | ARGK--SDFAWLSR---KSADKITPWNFDEIVDKES | 486 |
| EMC03581 | 413 | RAIIRRQAEFYPFLAD-NQD | RIEKILTFRIPYYVGPL | ARGK--SDFAWLSR---KSADKITPWNFDEIVDKES | 479 |
| WP_000428612 | 421 | NAILRRQGEHYPFLKE-NKE | KIEKILTFRIPYYVGPL | ARGN--RDFAWLTR---NSDQAIRPWNFEEIVDKAS | 487 |
| WP_000428613 | 421 | NAILRRQGEHYPFLKD-NKE | KIEQILTFRIPYYVGPL | ARGN--RDFAWLTR---NSDEAIRPWNFEEIVDKAS | 487 |
| WP_049528613 | 421 | NAILRHQGEKYPFLKE-NKD | KIEQILTFRIPYYVGPL | ARGN--RDFSWLTR---NSDEAIRPWNFEEMVDKSS | 487 |
| WP_003107102 | 389 | KSIIRRQGEKYYPFLKD-KQV | RIEKILFTFRIPYYVGPL | ANG-n-SSFAWVKR---RSNESITPWNFEEVVEQEA | 455 |
| WP_054279288 | 422 | QAILRRQQAYYPFLKD-NQE | QIEKILTFRIPYYIGPL | ARG-n-SRFAWLTR---TSDQKITPWNFDEMVDQEA | 488 |
| WP_049531101 | 421 | NAILRRQGEHYPFLKE-NRE | KIEKILTFRIPYYVGPL | ARGN--RDFAWLTR---NSDQAIRPWNFEEIVDKAS | 487 |
| WP_049538452 | 421 | NAILRRQGEHYPFLKE-NKE | KIEKILTFRIPYYVGPL | ASGN--RDFAWLTR---NSDQAIRPWNFEEIVDKAS | 487 |
| WP_049549711 | 421 | HAILRRQGEHYPFLAE-QKE | KIEQLLCFRIPYYVGPL | ARGN--RDFAWLTR---NSDQAIRPWNFEEIVDKAS | 487 |
| WP_007896501 | 422 | HAILRRQGEHYPFLAE-QKE | KIEQLLCFRIPYYVGPL | AKGGn-SSFAWLKR---RSDEPITPWNFKDVVDEEA | 489 |
| EFR44625 | 374 | HAILRRQGEKYYPFLKE-QKE | KIEQLLCFRIPYYVGPL | AKGGn-SSFAWLKR---RSDEPITPWNFKDVVDEEA | 441 |
| WP_002897477 | 420 | NAILRRQGEHYLFLKE-NRE | KIEKILAFRIPYYVGPL | ARDN--RDFSWLTR---NSDEPIRPWNFEEVVDKAR | 486 |
| WP_002906454 | 420 | NAILRRQGEHYLFLKE-NRE | KIEKILAFRIPYYVGPL | ARDN--RDFAWLTR---NSDQAIRPWNFEEVVDKAS | 486 |
| WP_009729476 | 421 | NAILRRQGEHYLFLKE-NKE | KIEKILTFRIPYYVGPL | ARGN--RDFAWLTR---NSDQAIRPWNFEEIVDKAS | 487 |

-continued

| ID | | | | | |
|---|---|---|---|---|---|
| CQR24647 | | KAILRRQGEFYPFLKE-NAE | KIQQLLTFKIPYYVGPL | ARGN--SRFAWASY---NSNEKMTPWNFDNVIDKTS | 487 |
| WP_000066813 | 421 | NAIIRRRQGEHYPFLQE-NKE | KIEKILTFRIPYYVGPL | ARGN--GDFAWLTR----NSDQAIRPWNFEEIVDQAS | 487 |
| WP_009754323 | 421 | NAILRRRQGEHYPLLKE-NNE | KIEKILTFRIPYYVGPL | ARGN--RDFAWLTR----NSDQAIRPWNFEEIVDKAS | 487 |
| WP_044674937 | 420 | HAIIRRRQAEFYPFLVE-NQD | KIEKILTFRIPYYVGPL | ARGK--SEFAWLNR----KSDEKIRPWNFDEMVDKET | 486 |
| WP_044676715 | 420 | HAIIRRRQAEFYPFLVE-NQD | KIEKILTFRIPYYVGPL | ARGK--SEFAWLNR----KSDEKIRPWNFDEMVDKET | 486 |
| WP_044680361 | 420 | HAIIRRRQAEFYPFLVE-NQD | KIEKILTFRIPYYVGPL | ARGK--SEFAWLNR----KSDEKIRPWNFDEMVDKET | 486 |
| WP_044681799 | 420 | HAIIRRRQAEFYPFLVE-NQD | KIEKILTFRIPYYVGPL | ARGK--SEFAWLNR----KSDEKIRPWNFDEMVDKET | 486 |
| WP_049533112 | 420 | HAILRRQEEHYPFLKE-NQD | KIEKILTFRIPYYVGPL | ARGK--SRFAWAEY----KADEKITPWNFDDILDKEK | 486 |
| WP_029090905 | 404 | VAILENQATYYPELLE-QKD | NIHKLLTFRIPYYVGPL | ADQKq-SEFAWMVR----KQAGKITPFNFEEMVDIDA | 471 |
| WP_006506696 | 430 | IKIIDNQAEYYPILKE-KRE | QLLSILTFRIPYYFGPL | ETSEh----AWIKRlegKENQRILPMNYQDIVDVDA | 498 |
| AIT42264 | 420 | HAILRRQEDFYPFLKD-NRE | KIISLLTFRIPYYVGPL | ARG-n-SRFAWMTR--KSEETITPWNFEEVVDKGA | 486 |
| WP_034440723 | 426 | TAVLDQQEKHYSFLKE-NRD | KIIALLTFRIPYYVGPL | AKGE-SRFAWLER---SNSEEKIKPWNEDKIVDIDK | 493 |
| AKQ21048 | 420 | HAILRRQEDFYPFLKD-NRE | KIEKILTFRIPYYVGPL | ARG-n-SRFAWMTR--KSEETITPWNFEEVVDKGA | 486 |
| WP_004636532 | 421 | QAILDRQSQYYPFLAE-NRD | KIESLVTFRIPYYVGPL | TVSDq-SEFAWMER---QSDEPIRPWNFDEIVNKER | 488 |
| WP_002364836 | 428 | QAIIHRQAAYYPFLKE-NQE | KIEQLVTFRIPYYVGPL | SKGDa-STFAWLKR---QSEEPIRPWNLQETVDLDQ | 495 |
| WP_016631044 | 379 | QAIIHRQAAYYPFLKE-NQE | KIEQLVTFRIPYYVGPL | SKGDa-STFAWLKR---QSEEPIRPWNLQETVDLDQ | 446 |
| EMS75795 | 163 | KAIIERQKPYYPSLEE-ARD | KMIRLLTFRIPYYVGPL | AQGEetSSFAWLKR---KTPEKVTPWNATEVIDYSA | 231 |
| WP_002373311 | 428 | QAIIHRQAAYYPFLKE-NQE | KIEQLVTFRIPYYVGPL | SKGDa-STFAWLKR---QSEEPIRPWNLQETVDLDQ | 495 |
| WP_002378009 | 428 | QAIIHRQAAYYPFLKE-NQE | KIEQLVTFRIPYYVGPL | SKGDa-NTFAWLKR---QSEEPIRPWNLQETVDLDQ | 495 |
| WP_002407324 | 428 | QAIIHRQAAYYPFLKE-NQE | KIEQLVTFRIPYYVGPL | SKGDa-STFAWLKR---QSEEPIRPWNLQETVDLDQ | 495 |
| WP_002413717 | 430 | QAIIHRQAAYYPFLKE-NQE | KIEQLVTFRIPYYVGPL | SKGDa-STFAWLKR---QSEEPIRPWNLQETVDLDQ | 497 |
| WP_010775580 | 428 | QAIIHRQAAYYPFLKE-NQK | KIEQLVTFRIPYYVGPL | SKGDa-STFAWLKR---QSEEPIRPWNLQETVDLDQ | 495 |
| WP_010818269 | 428 | QAIIHRQAAYYPFLKE-NQE | KIEQLVTFRIPYYVGPL | SKGDa-STFAWLKR---QSEEPIRPWNLQETVDLDQ | 495 |
| WP_010824395 | 428 | QAIIHRQAAYYPFLKE-NQE | KIEQLVTFRIPYYVGPL | SKGDa-STFAWLKR---QSEEPIRPWNLQETVDLDQ | 495 |
| WP_016622245 | 428 | QAIIHRQAAYYPFLKE-NQE | KIEQLVTFRIPYYVGPL | SKGDa-STFAWLKR---QNEKPIRPWNLQETVDLDQ | 495 |
| WP_033624816 | 428 | QAIIHRQAAYYPFLKE-NQK | KIEQLVTFRIPYYVGPL | SKGDa-STFAWLKR---QSEEPIRPWNLQETVDLDQ | 495 |
| WP_033625576 | 428 | QAIIHRQAAYYPFLKE-NQE | KIEQLVTFRIPYYVGPL | SKGDa-STFAWLKR---QSEEPIRPWNLQETVDLDQ | 495 |
| WP_033789179 | 428 | QAIIHRQAAYYPFLKE-NQK | KIEQLVTFRIPYYVGPL | SKGDa-STFAWLKR---QSEEPIRPWNLQETVDLDQ | 495 |
| WP_002310644 | 424 | RAIIANQKKYYPFLKE-EQE | KLESLLTFKIPYYVGPL | AKKQenSPFAWLIR---KSEEKIKPWNLPEIVDMEG | 492 |
| WP_002112694 | 425 | RAIIANQKKYYPFLKE-EQE | KLESLLTFKIPYYVGPL | AKKQenSPFAWLIR---KSEEKIKPWNLPEIVDMEG | 493 |
| WP_002314015 | 425 | RAIIANQKKYYPFLKE-EQE | KLESLLTFKIPYYVGPL | AKKQenSPFAWLIR---KSEEKIKPWNLPEIVDMEG | 493 |
| WP_002320716 | 425 | RAIIANQKKYYPFLKE-EQE | KLESLLTFKIPYYVGPL | AKKQenSPFAWLIR---KSEEKIKPWNLPEIVDMEG | 493 |
| WP_002330729 | 424 | RAIIANQKKYYPFLKE-EQE | KLESLLTFKIPYYVGPL | AKKQenSPFAWLIR---KSEEKIKPWNLPEIVDMEG | 492 |
| WP_002335161 | 425 | RAIIANQKKYYPFLKE-EQE | KLESLLTFKIPYYVGPL | AKKQenSPFAWLIR---KSEEKIKPWNLPEIVDMEG | 493 |
| WP_002345439 | 425 | KAIIDQQKKYYPFLEE-AGP | KIIALFKFKRIPYYVGPL | AKEQeaSSFAWIER---KTAEKINPWNFSEVVDIEK | 493 |
| WP_034867970 | 418 | KAIIDQQKKYYPFLEE-AGP | KIIALFKFKRIPYYVGPL | AKEQeaSSFAWIER---KTAEKINPWNFSEVVDIEK | 486 |
| WP_047937432 | 425 | RAIIANQKKYYPFLKE-EQE | KLESLLTFKIPYYVGPL | AKKQenSPFAWLIR---KSEEKIKPWNLPEIVDMEG | 493 |
| WP_010720994 | 418 | KAIIDQQKQHYPFLEE-AGP | KIIALFKFKRIPYYVGPL | AKEQeaSSFAWIER---KTAEKINPWNFSEVVDIEK | 486 |
| WP_010733004 | 418 | KAIIDQQKQHYPFLEE-AGP | KIIALFKFKRIPYYVGPL | AKEQeaSSFAWIER---KTAEKINPWNFSEVVDIEK | 486 |
| WP_034700478 | 418 | KAIIDQQKQHYPFLEE-AGP | KIIALFKFKRIPYYVGPL | AKEQeaSSFAWIER---KTAEKINPWNFSEVVDIEK | 486 |
| WP_072009003 | 422 | RAILRKQKYYSFLKE-NHH | KIEQIFKVRIPYYVGPL | KSDEPIRPWMNDVVDENA | 490 |
| WP_023519017 | 418 | REIMDRQKRPYPFLKG-AQG | KIEKLLTFKIPYYVGPL | KSPSQITPWNFAEVVDKEN | 485 |
| WP_010770040 | 423 | EAIIQKQATYYPFLAD-NKE | EMKQLVTFRIPYYVGPL | ADGN---SPFAWLER---ISSEPIRPGNLAEVVDIKK | 489 |
| WP_048604708 | 419 | KAILHHQAMYYPFLQE-KFS | NFVDLLTFRIPYYVGPL | ANGN--SRFSWLSR---KSDEPIRPWNLAEVVDLSK | 485 |
| WP_010750235 | 418 | KAIIDQQKQYYPFLEK-SKE | KMIQLLTFRIPYYVGPL | AQDKetsSFAWLER---KTTEKIKPWNAKDVIDYGA | 486 |
| AII16583 | 459 | HAILRRQEDFYPFLKD-NRE | KIEKILTFRIPYYVGPL | ARG-n-SRFAWMTR--KSEETITPWNFEEVVDKGA | 525 |
| WP_029073316 | 436 | NKILENQSVVYSDLKD-NED | KIRSILTFRIPYYFGPL | ITKDr-QFDWIIKKegKENERILPWNANEIVDVDK | 506 |
| WP_031589969 | 436 | NKILENQSVVYSDLKD-NED | KIRSILTFRIPYYFGPL | ITKDr-QFDWIIKKegKENERILPWNANEIVDVDK | 506 |
| KDA45870 | 418 | VAIVENQGKYYPFLRE-NKD | KFPEKILNFRIPYYVGPL | ARGN--SKFAWLTR--a-GEGKITPYNFDEMIDKET | 484 |
| WP_039099354 | 426 | DRIIENQQQYYPWLAE-INPN | KLDELVAFRVPYYVGPL | QQQSsdAKFAWMIR---KAEGQITPWNFDDKVDRQA | 509 |
| AKP02966 | 416 | EKIIDNQSQYYPFLKE-NKE | KLLSILSFRIPYYVGPL | -QSSekNPFAWMER---KSNGHARPWNFDEIVDREK | 483 |
| WP_010991369 | 426 | EAILHQQAKYYPFLKE-NYD | KIKSLVTFRIPYYVGPL | ANGQ--SEFAWLTR---KADGEIRPWNIEEKVDFGK | 492 |
| WP_033838504 | 426 | EAILHQQAKYYPFLKE-NYD | KIKSLVTFRIPYYVGPL | ANGQ--SEFAWLTR---KADGEIRPWNIEEKVDFGK | 492 |
| EHN60060 | 429 | EAILHQQAKYYPFLKE-NYD | KIKSLVTFRIPYFVGPL | ANGQ--SEFAWLTR---KADGEIRPWNIEEKVDFGK | 495 |

```
EFR89594              195 EAILHQQAKYYPFLKE--NYD KIKSLVTFRIPYFVGPL ANGQ--SEFAWLTR----KADGEIRPWNIEEKVDFGK 261
WP_038409211          426 EAILHQQAKYYPFLRK--DYE KIRSLVTFRIPYFIGPL ANGQ--SDFAWLTR----KADGEIRPWNIEEKVDFGK 492
EFR95520               45 EAILHQQAKYYPFLKE--DYE KIRSLVTFRIPYFIGPL ANGQ--SDFAWLTR----KADGEIRPWNIEEKVDFGK 111
WP_003723650          426 EAILHQQAKYYPFLKE--DYD KIKSLVTFRIPYFVGPL ANGQ--SEFAWLTR----KADGEIRPWNIEEKVDFGK 492
WP_003727705          426 EAILHQQAKYYPFLRE--GYD KIKSLVTFRIPYFVGPL ANGQ--SEFAWLTR----KDDGEIRPWNIEEKVDFGK 492
WP_003730785          426 EAILHQQAKYYPFLRE--GYD KIKSLVTFRIPYFVGPL ANGQ--SEFAWLTR----KADGEIRPWNIEEKVDFGK 492
WP_003733029          426 EAILHQQAKYYPFLRE--DYE KIKSLVTFRIPYFVGPL AKGQ--SEFAWLTR----KADGEIRPWNIEEKVDFGK 492
WP_003739838          426 EAIIHQQAKYYPFLKE--AYD KIKSLVTFRIPYFVGPL AKGQ--SDFAWLTR----KADGEIRPWNIEEKVDFGK 492
WP_014601172          426 EAIIHQQAKYYPFLRE--DYE KIKSLVTFRIPYFVGPL AKGQ--SEFAWLTR----KADGEIRPWNIEEKVDFGK 492
WP_023548323          426 EAIIHQQAKYYPFLRE--DYE KIKSLVTFRIPYFVGPL AKGQ--SDFAWLTR----KADGEIRPWNIEEKVDFGK 492
WP_031665337          426 EAIIHQQAKYYPFLRE--DYE KIKSLVTFRIPYFVGPL AKGQ--SEFAWLTR----KADGEIRPWNIEEKVDFGK 492
WP_031669209          426 EAILHQQAKYYPFLKE--DYE KIKSLVTFRIPYFVGPL AKGQ--SEFAWLTR----KADGEIRPWNIEEKVDFGK 492
WP_033920898          426 EAIIHQQAKYYPFLKE--DYE KIKSLVTFRIPYFVGPL AKGQ--SEFAWLTR----KADGEIRPWNIEEKVDFGK 492
AKI42028              429 EAIIHQQAKYYPFLRE--DYE KIKSLVTFRIPYFVGPL AKGQ--SEFAWLTR----KADGEIRPWNIEEKVDFGK 495
AKI50529              429 EAIIHQQAKYYPFLRE--DYE KIKSLVTFRIPYFVGPL AKGQ--SEFAWLTR----KADGEIRPWNIEEKVDFGK 495
EFR83390                  ------------------- ----------------- ---------------- ---------------------
WP_046323366          426 EAILHQQAKYYPFLKV--DYE KIKSLVTFRIPYFVGPL ANGQ--SEFSWLTR----KADGEIRPWNIEEKVDFGK 492
AKE81011              436 HAILRRQEDFYPFLKD--NRE KIEKILTFRIPYYFGPL ARG-n-SRFAWMTR----KSEETITPWNFEEVVDKGA 502
CUO82355              434 IKIIDNQAKYYPVLKE--KRE KLISILEFRIPYYFGPL ETSEh----AWIKRlegKENQRILPWNYQDTVDVDA   502
WP_033162887          435 IQIIDNQSVYYPQLKE--NRD KIKSILEFRIPYYFGPL AHSE---FAWIKKfedKQKERILPWNYDQIVDIDA    503
AGZ01981              453 HAILRRQEDFYPFLKD--NRE KIEKILTFRIPYYVGPL ARG-n-SRFAWMTR----KSEETITPWNFEEVVDKGA 519
AKA60242              420 HAILRRQEDFYPFLKD--NRE KIEKILTFRIPYYVGPL ARG-n-SRFAWMTR----KSEETITPWNFEEVVDKGA 486
AKS40380              420 HAILRRQEDFYPFLKD--NRE KIEKILTFRIPYYVGPL ARG-n-SRFAWMTR----KSEETITPWNFEEVVDKGA 486
4UN5_B                424 HAILRRQEDFYPFLKD--NRE KIEKILTFRIPYYVGPL ARG-n-SRFAWMTR----KSEETITPWNFEEVVDKGA 490

-continued

WP_010922251          487 SAQSFIERMTNFDKNLPNEKVLPKHSLLYEYFTVNELTKVKYVT-EGMRKPaFLSCEQKKAIVDLLFK--TNR-KVTV 561

WP_039695303          490 SAEKFITRMTLNDLYLPEEKVLPKHSHVLETYAVVNELTKIKYVN-EQGKES-FFDSNMKQEIFDHVFK--ENR-KVTK 563
WP_045635197          487 SAEDINKMTNYDLYLPEEKVLPKHSLLYETFAVVNELTKVKFIA-EGLRDYqFLDSQKKQIVNQLFK--ENR-KVTE 561
5AXW_A                230 --KEWYEMLMGHCTYFPEELRSVKYAYNADLYNALNDLNNLVITR--DENEKLeYE--KFQIIENVFK--QKK-KPTL 299
WP_009880683          171 SAQSFIERMTNFDKNLPNEKVLPKHSLLYEYFTVNELTKVKYVT-EGMRKPaFLSGEQKKAIVDLLFK--TNR-KVTV 245
WP_010922251          487 SAQSFIERMTNFDKNLPNEKVLPKHSLLYEYFTVNELTKVKYVT-EGMRKPaFLSGEQKKAIVDLLFK--TNR-KVTV 561
WP_011054416          487 SAQSFIERMTNFDKNLPNEKVLPKHSLLYEYFTVNELTKVKYVT-EGMRKPaFLSGEQKKAIVDLLFK--TNR-KVTV 561
WP_011284745          487 SAQSFIERMTNFDKNLPNEKVLPKHSLLYEYFTVNELTKVKYVT-EGMRKPaFLSGEQKKAIVDLLFK--TNR-KVTV 561
WP_011285506          487 SAQSFIERMTNFDKNLPNEKVLPKHSLLYEYFTVNELTKVKYVT-EGMRKPaFLSGEQKKAIVDLLFK--TNR-KVTV 561
WP_011527619          487 SAQSFIERMTNFDKNLPNEKVLPKHSLLYEYFTVNELTKVKYVT-EGMRKPaFLSGEQKKAIVDLLFK--TNR-KVTV 561
WP_012560673          487 SAQSFIERMTNFDKNLPNEKVLPKHSLLYEYFTVNELTKVKYVT-EGMRKPaFLSGEQKKAIVDLLFK--TNR-KVTV 561
WP_014407541          487 SAQSFIERMTNFDKNLPNEKVLPKHSLLYEYFTVNELTKVKYVT-EGMRKPaFLSGEQKKAIVDLLFK--TNR-KVTV 561
WP_020905136          487 SAQSFIERMTNFDKNLPNEKVLPKHSLLYEYFTVNELTKVKYVT-EGMRKPaFLSGEQKKAIVDLLFK--TNR-KVTV 561
WP_023080005          487 SAQSFIERMTNFDKNLPNEKVLPKHSLLYEYFTVNELTKVKYVT-EGMRKPaFLSGEQKKAIVDLLFK--TNR-KVTV 561
WP_023610282          487 SAQSFIERMTNFDKNLPNEKVLPKHSLLYEYFTVNELTKVKYVT-EGMRKPaFLSGEQKKAIVDLLFK--TNR-KVTV 561
WP_030125963          487 SAQSFIERMTNFDKNLPNEKVLPKHSLLYEYFTVNELTKVKYVT-EGMRKPaFLSGEQKKAIVDLLFK--TNR-KVTV 561
WP_030126706          487 SAQSFIERMTNFDKNLPNEKVLPKHSLLYEYFTVNELTKVKYVT-EGMRKPaFLSGEQKKAIVDLLFK--TNR-KVTV 561
WP_031488318          487 SAQSFIERMTNFDKNLPNEKVLPKHSLLYEYFTVNELTKVKYVT-EGMRKPeFLSGEQKKAIVDLLFK--TNR-KVTV 561
WP_032461047          487 SAQSFIERMTNFDKNLPNEKVLPKHSLLYEYFTVNELTKVKYVT-EGMRKPaFLSGEQKKAIVDLLFK--TNR-KVTV 561
WP_032461140          487 SAQSFIERMTNFDKNLPNEKVLPKHSLLYEYFTVNELTKVKYVT-EGMRKPaFLSGEQKKAIVDLLFK--TNR-KVTV 561
WP_032462016          487 SAQSFIERMTNFDKNLPNEKVLPKHSLLYEYFTVNELTKVKYVT-EGMRKPaFLSGEQKKAIVDLLFK--TNR-KVTV 561
WP_032462936          487 SAQSFIERMTNFDKNLPNEKVLPKHSLLYEYFTVNELTKVKYVT-EGMRKPaFLSGEQKKAIVDLLFK--TNR-KVTV 561
WP_032464890          487 SAQSFIERMTNFDKNLPNEKVLPKHSLLYEYFTVNELTKVKYVT-EGMRKPaFLSGEQKKAIVDLLFK--TNR-KVTV 561
WP_033888930          312 SAQSFIERMTNFDKNLPNEKVLPKHSLLYEYFTVNELTKVKYVT-EGMRKPaFLSGEQKKAIVDLLFK--TNR-KVTV 386
WP_038431314          487 SAQSFIERMTNFDKNLPNEKVLPKHSLLYEYFTVNELTKVKYVT-EGMRKPaFLSGEQKKAIVDLLFK--TNR-KVTV 561
WP_038432938          487 SAQSFIERMTNFDKNLPNEKVLPKHSLLYEYFTVNELTKVKYVT-EGMRKPaFLSGEQKKAIVDLLFK--TNR-KVTV 561
WP_038434062          398 SAQSFIERMTNFDKNLPNEKVLPKHSLLYEYFTVNELTKVKYVT-EGMRKPaFLSGEQKKAIVDLLFK--TNR-KVTV 472
BAQ51233
```

-continued

```
KGE60162                                                                                                                                            
KGE60856                                                                                                                                            
WP_002989955     487 SAQSIERMTNFDKNLPNEKVLPNEKVLPKHSLLYEYFTVNELTKVKVT--EGMRKPaFLSGEQKKAIVDLFK--TNR-KVTV 561
WP_003030002     487 SAEKPITRMTLNDLYLPEEKVLPEEKVLPKHSLLYETFTVNELTKVKVN--EQGEAK-FFDANMKQEIFDHVEK--ENR-KVTK 560
WP_003065552     490 SAEKPITRMTLNDLYLPEEKVLPEEKVLPKHSHVETYAVVNELTKIKYVN--EQGKDS-FFDSNMKQEIFDHVEK--ENR-KVTK 563
WP_001040076     488 SAEAPIHRMTNNDFYLPEEKVLPEEKVLPKHSLIYEKFTVRFLA--EGFKDFqFLNRKQEIFDGVFK--EKR-KVTE 562
WP_001040078     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040080     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040081     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040083     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040085     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040087     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040088     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040089     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040090     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040091     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040092     488 SAEAPIHRMTNNDFYLPEEKVLPEEKVLPKHSLIYEKFTVNELTKVRYQN--EQGETY-FFDSNVKQEIFDGVFK--EHR-KVSK 561
WP_001040094     488 SAEAPIHRMTNNDFYLPEEKVLPEEKVLPKHSLIYEKFTVNELTKVRFLA--EGFKDFqFLNRKQEIFDGVFK--EKR-KVTE 562
WP_001040095     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040096     488 SAEAPIHRMTNNDFYLPEEKVLPEEKVLPKHSLIYEKFTVNELTKVRFLA--EGFKDFqFLNRKQEIFDGVFK--EKR-KVTE 562
WP_001040097     488 SAEAPIHRMTNNDFYLPEEKVLPEEKVLPKHSLIYEKFTVNELTKVRFLA--EGFKDFqFLNRKQEIFDGVFK--EKR-KVTE 562
WP_001040098     488 SAEAPIHRMTNNDFYLPEEKVLPEEKVLPKHSLIYEKFTVNELTKVRFLA--EGFKDFLNRKQEIFDGVFK--EKR-KVTE 562
WP_001040099     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040104     488 SAEAPIHRMTNNDFYLPEEKVLPEEKVLPKHSLIYEKFTVNELTKVRFLA--EGFKDFLNRKQEIFDGVFK--EKR-KVTE 562
WP_001040105     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040106     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040107     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040108     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040109     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_001040110     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_015058523     488 SAEAPIHRMTNNDFYLPEEKVLPEEKVLPKHSLIYEKFTVNELTKVRYQN--EQGETY-FFDSNVKQEIFDGVFK--EHR-KVSK 561
WP_017643650     488 SAEAPIHRMTNNDFYLPEEKVLPEEKVLPKHSLIYEKFTVNELTKVRFLA--EGFKDFqFLNRKQEIFDGVFK--EKR-KVTE 562
WP_017647151     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_017648376     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_017649527     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_017771611     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_017771984     488 SAEAPIHRMTNNDFYLPEEKVLPEEKVLPKHSLIYEKFTVNELTKVRYQN--EQGETY-FFDSNIKQEIFDGVFK--EHR-KVSK 561
CFQ25032         488 SAEAPIHRMTNNDFYLPEEKVLPEEKVLPKHSLIYEKFTVNELTKVRYQN--EQGETY-FFDSNIKQEIFDGVFK--EHR-KVSK 561
CFV16040         488 SAEAPIHRMTNNDFYLPEEKVLPEEKVLPKHSLIYEKFTVNELTKVRYQN--EQGETY-FFDSNIKQEIFDGVFK--EHR-KVSK 561
KLJ37842         488 SAEAPIHRMTNNDFYLPEEKVLPEEKVLPKHSLIYEKFTVNELTKVRYQN--EQGETY-FFDSNIKQEIFDGVFK--EHR-KVSK 561
KLJ72361         488 SAEAPIHRMTNNDFYLPEEKVLPEEKVLPKHSLIYEKFTVNELTKVRYQN--EQGETY-FFDSNIKQEIFDGVFK--EHR-KVSK 561
KLL20707         488 SAEAPIHRMTNNDFYLPEEKVLPEEKVLPKHSLIYEKFTVNELTKVRYQN--EQGETY-FFDSNIKQEIFDGVFK--EHR-KVSK 561
KLL42645         488 SAEAPIHRMTNNDFYLPEEKVLPEEKVLPKHSLIYEKFTVNELTKVRFLA--EGFKDFqFLNRKQEIFDGVFK--EKR-KVTE 562
WP_047202273     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_047209694     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_050198062     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_050201642     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_050204027     488 SAEAPIHRMTNNDFYLPEEKVLPEEKVLPKHSLIYEKFTVNELTKVRYQN--EQGETY-FFDSNIKQEIFDGVFK--EHR-KVSK 561
WP_050881965     488 SAEAPIHRMTNNDFYLPEEKVLPEEKVLPKHSLIYEKFTVNELTKVRYQN--EQGETY-FFDSNVKQEIFDGVFK--EHR-KVSK 561
WP_050886065     488 SAEAPIHRMTNNDFYLPEEKVLPEEKVLPKHSLIYEKFTVNELTKVRYQN--EQGETY-FFDSNIKQEIFDGVFK--EHR-KVSK 561
AHN30376         488 SAEAPIHRMTNNDFYLPEEKVLPEEKVLPKHSLIYEKFTVNELTKVRYQN--EQGETY-FFDSNIKQEIFDGVFK--EHR-KVSK 561
EAO78426         488 SAEAPIHRMTNNDFYLPEEKVLPEEKVLPKHSLIYEKFTVNELTKVRYQN--EQGETY-FFDSNIKQEIFDGVFK--EHR-KVSK 561
CCW42055         488 SAEAPIHCMTNNDLYLPEEKVLPEEKVLPKHSLIYEKFTVNELTKVRYQN--EQGETY-FFDSNIKQEIFDGVFK--EYR-KVSK 561
```

```
                                                           -continued

WP_003041502    487  SAEKFITRMTLNDLYLPEEKVLPKHSLLYETFVNELTKVKYVN--EQGEAK-FFDDANMKQEIFDHVFK--ENR-KVTK  560
WP_037593752    488  SAEKFITRMTLNDLYLPEEKVLPKHSPLYETFVNELTKVKYVN--EQGEAK-FFDTNMKQEIFDHVFK--ENR-KVTK  561
WP_049516684    488  SAEKFITRMTLNDLYLPEEKVLPKHSPLYETFVNELTKVKYVN--EQGEAK-FFDTNMKQEIFDHVFK--ENR-KVTK  561
GAD46167        487  SAEKFITRMTLNDLYLPEEKVLPKHSPLYETFVNELTKVKYVN--EQGEAK-FFDTNMKQEIFDHVFK--ENR-KVTK  560
WP_018363470    488  SAEKFITRMTLNDLYLPEEKVLPKHSHVETFAVNELTKVKYVN--EQGKDS-FFDSNMKQEIFDHVFK--ENR-KVTK  561
WP_003043819    497  SAEKFIERMTLNDLYLPDEQLPNKKVLPKHSLLYEYFTVNELTKVKVYT--ERMRKPeFLSGEQKKAIVDLLFK--TNR-KVTV  571
WP_006269658    487  SAEKFITRMTLNDLYLPEEKVLPKHSLLYEAFTVNELTKVKVYN--EQGEAK-FFDTNMKQEIFDHVFK--ENR-KVTK  560
WP_048800889    487  SAEKFITRMTLNDLYLPEEKVLPKHSLLYEYFTVNELTKVKVYN--EQGEAK-FFDANMKQEIFDHVFK--ENP-KVTK  560
WP_012767106    487  SAQSFIERMTNFDEQLPNEKVLPKHSLLYEYFTVNELTKVKVYT--ERMRKPeFLSGKQKEAIVDLLFK--TNR-KVTV  560
WP_014612333    487  SAQSFIERMTNFDKNLPNEKVLPKHSLLYEYFTVNELTKVKVYT--EGMRKPeFLSGKQKEAIVDLLFK--TNR-KVTV  560
WP_015017095    487  SAQSFIERMTNFDKNLPNEKVLPKHSLLYEYFTVNELTKVKVYT--EGMRKPeFLSGKQKEAIVDLLFK--TNR-KVTV  560
WP_015057649    487  SAQSFIERMTNFDKNLPNEKVLPKHSLLYEYFTVNELTKVKVYT--EGMRKPeFLSGKQKEAIVDLLFK--TNR-KVTV  560
WP_048327215    487  SAQSFIERMTNFDKNLPNEKVLPKHSLLYEYFTVNELTKVKVYT--EGMRKPaFLSGEQKKAIVDLLFK--TNR-KVTV  560
WP_049519324    487  SAQSFIERMTNFDKNLPNEKVLPKHSLLYEYFTVNELTKVKYAT--EGMTRPqFLSADQKQAIVDLLFK--TNR-KVTV  560
WP_012515931    487  SAQIFIEKMTKNDLYLPNEKVLPKHSLLYETFVNELTKVKVYT--EGMTRPqFLSADQKQAIVDLLFK--TNR-KVTV  560
WP_021320964    487  SAQIFIEKMTKNDLYLPNEKVLPKHSLLYETFVNELTKVKYAT--EGMTRPqFLSADQKQAIVDLLFK--TNR-KVTV  560
WP_037581760    487  SAQIFIEKMTKNDLYLPNEKVLPKHSLLYETFVNELTKVKYAT--EGMTRPqFLSADQKQAIVDLLFK--TNR-KVTV  560
WP_004324281    487  SAEKFITRMTLNDLYLPEEKVLPKHSYVETFAVNELTKIKVKN--EQGKSF-FFDSNMKQEIFDHVFK--ENR-KVTK  560
WP_009854540    488  SAEKFITRMTLNDLYLPEEKVLPKHSHVETFYAVNELTKVKVYN--EQGKSN-FFDANMKQEIFEHVFK--ENR-KVTK  561
WP_012962174    488  SAEKFITRMTLNDLYLPEEKVLPKHSHVETFTVNELTKVKVYN--EQGKES-FFDSNMKQEIFDHVFK--ENR-KVTK  561
WP_039695303    490  SAEKFITRMTLNDLYLPEEKVLPKHSHVETFTVNELTKVKYQT--EQGESF-FFDANMKQEIFDHVFK--ENR-KVTK  563
WP_014334983    487  SARAFIERMTNFDTYLPEEKVLPKHSPLYEMFVNELTKVKYQT--EGMKRPvFLSSEDKEEIVNLLFK--KVTV  560
WP_003092269    487  SARAFIERMTNFDTYLPEEKVLPKHSPLYEMFVNELTKVKYQT--EGMKRPvFLSSEDKEEIVNLLFK--KER-KVTV  561
AHY15608        487  SARAFIERMTNFDTYLPEEKVLPKHSPLYEMFVNELTKVKYQT--EGMKRPvFLSSEDKEEIVNLLFK--KER-KVTV  560
AHY17476        487  ------------------------------------------------------------------------------
ESR09100        487  SAEAFINRMTNFDFTYLPEEKVLPNQKVLPKHSPLYEMFVNELTKVKYKT--EGMKRP-FLSSEDKEEIVNLLFK--KER-KVTV  560
AGM98575        487  SAEAFINRMTNYDLYLPNQKVLPKHSLLYEKFTVNELTKVKYKT--EQGKTA-FFDANMKQEIFDGVFK--VYR-KVTK  560
ALF27331        500  SASRFIERMTLHDLYLPDEKVLPRHSLIYEKYTVNELTKVKRFTP-EGGKEV-YFSKTDKENIFDSLFK--RYR-KVTK  573
WP_018372492    488  SAEDFINKMTNYDLYLPEEKVLPKHSLLYEKFTVNELTKVKFIA--EGLRDYqFLDSGQKQQIVNQLFK--EKR-KVTE  562
WP_045618028    487  SAEDFINKMTNYDLYLPEEKVLPKHSLLYEKFTVNELTKVKFIA--EGLRDYqFLDSGQKKQIVNQLFK--ENR-KVTE  561
WP_045635197    487  SAEAFINRMTNYDLYLPNQKVLPKHSLLYEKFTVNELTKVKYKT--EQGKTA-FFDANMKQEIFDGVFK--VYR-KVTK  560
WP_002263549    487  SAEAFINRMTNYDLYLPNQKVLPKHSLLYEKFTVNELTKVKYKT--EQGKTA-FFDANMKQEIFDGVFK--VYR-KVTK  560
WP_002263887    487  SAEAFINRMTNYDLYLPNQKVLPKHSLLYEKFTVNELTKVKYKT--EQGKTA-FFDANMKQEIFDGVFK--VYR-KVTK  560
WP_002264920    487  SVEAFINRMTNYDLYLPNQKVLPKHSLLYEKFTVNELTKVKYKT--EQGKTA-FFDANMKQEIFDGVFK--VYR-KVTK  560
WP_002269043    487  SVEAFINRMTNYDLYLPNQKVLPKHSLLYEKFTVNELTKVKYKT--EQGKTA-FFDANMKQEIFDGVFK--VYR-KVTK  560
WP_002269448    487  SAEAFINRMTNYDLYLPNQKVLPKHSLLYEKFTVNELTKVKYKT--EQGKTA-FFDANMKQEIFDGVFK--VYR-KVTK  560
WP_002271977    487  SAEAFINRMTNYDLYLPNQKVLPKHSLLYEKFTVNELTKVKYKT--EQGKTA-FFDANMKQEIFDGVFK--VYR-KVTK  560
WP_002272766    487  SAEAFINRMTNYDLYLPNQKVLPKHSLLYEKFTVNELTKVKYKT--EKR-EQGKTA-FFDANMKQEIFDGVFK--EKR-KVTE  560
WP_002273241    487  SAEAFINRMTNYDLYLPNQKVLPKHSLLYEKFTVNELTKVKYKT--EQGKTA-FFDANMKQEIFDGVFK--VYR-KVTK  560
WP_002275430    487  SAEAFINRMTNYDLYLPNQKVLPKHSLLYEKFTVNELTKVKYKT--EQGKTA-FFDANMKQEIFDGVFK--VYR-KVTK  560
WP_002276448    487  SAEAFINRMTNYDLYLPNQKVLPKHSLLYEKFTVNELTKVKYKT--EQGKTA-FFDANMKQEIFDGVFK--VYR-KVTK  560
WP_002277050    487  SAQAFINRMTNYDLYLPNQKVLPKHSLLYEKFTVNELTKIKYVT--EIGEAK-FFDANLKQEIFDGLFK--VYR-KVTK  560
WP_002773364    487  SAEAFINRMTNYDLYLPNQKVLPKHSLLYEKFTVNELTKIKYKT--EQGKTA-FFDANMKQEIFDGVFK--VYR-KVTK  560
WP_002779025    487  SAEAFINRMTNYDLYLPNQKVLPKHSLLYEKFTVNELTKVKYKT--EQGKTA-FFDANMKQEIFDGVFK--VYR-KVTK  560
WP_002799859    487  SVEAFINRMTNYDLYLPNQKVLPKHSLLYEKFTVNELTKVKYKT--EQGETA-FFDANMKQEIFDGVFK--VYR-KVTK  560
WP_002280230    487  SVEAFINRMTNYDLYLPNQKVLPKHSLLYEKFTVNELTKVKYKT--EQGKTA-FFDANMKQEIFDGVFK--VYR-KVTK  560
WP_002281696    487  SAEAFINRMTNYDLYLPNQKVLPKHSLLYEKFTVNELTKVKYKT--EQGKTA-FFDANMKQEIFDGVFK--VYR-KVTK  560
WP_002282247    487  SAEAFINREHMTNYDLYLPNQKVLPKHSLLYEKFTVNELTKVKYKT--EIGEAK-FFDANMKQEIFDGLFK--HER-KVTK  560
WP_002282906    487  SAEAFINRMTNYDLYLPNQKVLPKHSLLYEKFTVNELTKVKYKT--EQGKTA-FFDANMKQEIFDGLFK--VYR-KVTK  560
WP_002283846    487  SAEAFINRMTNYDLYLPNQKVLPKHSLLYEKFTVNELTKVKYKT--EQGKTA-FFDANMKQEIFDGVFK--VYR-KVTK  560
WP_002287255    487  SVEAFINRMTNYDLYLPNQKVLPKHSLLYEKFTVNELTKVKYKT--EQGKTA-FFDANMKQEIFDGVFK--VYR-KVTK  560
WP_002288990    487  SVEAFINRMTNYDLYLPNQKVLPKHSLLYEKFTVNELTKVKYKT--EQGKTA-FFDANMKQEIFDGVFK--HER-KVTK  560
WP_002289641    487  SAEAFINRMTNYDLYLPNQKVLPKHSLLYEKFTVNELTKVKYKT--EQGKTA-FFDANLKQEIFDGVFK--VYR-KVTK  560
WP_002290427    487  SAEAFINRMTNYDLYLPNQKVLPKHSLLYEKFTVNELTKVKYKT--EQGKTA-FFDANMKQEIFDGVFK--VYR-KVTK  560
```

-continued

| ID | Start | Sequence | End |
|---|---|---|---|
| WP_002295753 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_002296423 | 487 | SVEAFINRMTNYDLYLPNQKVLPKHSLLYEKFTVNELTKVKYKT-EQGKTA-FFDANMKQEIFDGVFK--VYR-KVTK | 560 |
| WP_002304487 | 497 | SAEKFITRMTLNDLYLPEEKVLPKHSLLYETFTVYNELTKVKYVN-EQGEAK-FFDANMKQEIFDHVEK--ENR-KVTK | 570 |
| WP_002305844 | 487 | SVEAFINRMTNYDLYLPNQKVLPKHSLLYEKFTVNELTKVKYKT-EQGKTA-FFDANMKQEIFDGVFK--VYR-KVTK | 560 |
| WP_002307203 | 487 | SVEAFINRMTNYDLYLPNQKVLPKHSLLYEKFTVNELTKVKYKT-EQGKTA-FFDANMKQEIFDGVFK--VYR-KVTK | 560 |
| WP_002310390 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_002352408 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_012997688 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_014677909 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_019312892 | 487 | SAEAFINRMTNYDLYLPNQKVLPKHSLLYEKFTVNELTKVKYKT-EQGKTA-FFDANLKQEIFDGLFK--HER-KVTK | 560 |
| WP_019313659 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_019314093 | 487 | SVEAFINRMTNYDLYLPNQKVLPKHSLLYEKFTVNELTKVKYKT-EQGKTA-FFDANMKQEIFDGLFK--HER-KVTK | 560 |
| WP_019315370 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_019803776 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_019805234 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_024783594 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_024784288 | 487 | SAQAFIEHMTNNDLYLPNEKVLPKHSPLYEKYTVNELTKIKYVT-EIGEAK-FFDANLKQEIFDGLFK--HER-KVTK | 560 |
| WP_024784666 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_024784894 | 487 | SAQAFIEHMTNNDLYLPNEKVLPKHSPLYEKYTVNELTKIKYVT-EIGEAK-FFDANLKQEIFDGLPK--HER-KVTK | 560 |
| WP_024786433 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_049473442 | 487 | SAEAFINRMTNYDLYLPNQKVLPKHSLLYEKFTVNELTKVKYKT-EQGKTA-FFDANMKQEIFDGVFK--VYR-KVTK | 560 |
| WP_049474547 | 480 | SAEAFINRMTNYDLYLPNQKVLPKHSLLYEKFTVNELTKVKYKT-EQGKTA-FFDANMKQEIFDGVFK--VYR-KVTK | 553 |
| EMC03581 | 488 | SAESFINKMTNYDLYLPDEKVLPKHSLLYETFAVNELTKVKFIA-EGLRDYqFLDSRQKKDIFYTLFKaeDKR-KVTE | 564 |
| WP_000428612 | 488 | SAEDFIHRMTNYDLYLPEEKVLPKHSLLYETFAVNELTKVKFIA-EGLRDYqFLDSQKKQIVTQLFK--EKR-KVTE | 562 |
| WP_000428613 | 487 | SAEDFINKMTNYDLYLPDEKVLPKHSLLYETFAVNELTKVKFIA-EGMKDYqFLDSQKKQIVNQLFK--EKR-KVTE | 561 |
| WP_049523028 | 456 | SAKVFIERMTNYDLYLPEEKVLPKHSLLYETFAVNEMFTVNELTKVKYQA-EGMRKPeFLSSEEKIEIVSNLFK--TER-KVTV | 530 |
| WP_003107102 | 488 | SAQAFIERMTNYDLYLPQEKVLPKHSLLTYEYFTVNELTKVKFIA-EGMTKPeFLSAGQKEQIVELLFK--KYR-KVTK | 563 |
| WP_049531101 | 489 | SAEDFINKMTNYDLYLPDEKVLPKHSLLYETFAVNELTKVKFIA-EGLRDYqFLDSQKKKINQLFK--EKR-KVTE | 562 |
| WP_049538452 | 488 | SAEDFINKMTNYDLYLPEEKVLPKHSLLYETFAVNELTKVKFIA-EGLRDYqFLDSGQKKQIVNQLFK--EKR-KVTE | 562 |
| WP_049549711 | 488 | SAQAFIEGMTNYDLYLPEEKVLPKHSPLYEMFTVNELTKVKYIA-ENMTKPIYLSAQKKEAIIDHLFK--QTR-KVTV | 564 |
| WP_007896501 | 490 | SAQAFIEGMTNYDLYLPEEKVLPKHSPLYEMFTVNELTKVKYIA-ENMTKPIYLSAQKEAIIDHLFK--QTR-KVTV | 564 |
| EFR44625 | 442 | SAEDFIHRMTNYDLYLPEEKVLPKHSLLYETFAVNELTKVKFIA-EGLRDYqFLDSGQKKQIVNQLFK--EKR-KVTE | 516 |
| WP_002897477 | 487 | SAEDFINKMTNYDLYLPEEKVLPKHSLLYETFAVNELTKVKFIA-EGLRDYqFLDSQKKQIVNQLFK--DKR-KVTE | 561 |
| WP_002906454 | 487 | SAQSFIERMTNNDLYLPDQKVLPKHSLLYETFAVNELTKVKFIA-EGLRDYqFLDSQKKQIVTQLFK--EKR-KVTE | 561 |
| WP_009729476 | 488 | SAQAFIERMTNNDLYLPDQKVLPKHSLLYETFAVNELTKIKYVT-ETGEAR-LEDVFLKKEIFDGLEK--KER-KVTK | 562 |
| CQR24647 | 488 | SAEDFINKMTNYDLYLPDQKVLPKHSLLYQKFAVNELTKIKYVT-ETGEAR-LEDVFLKKEIFDGLEK--KER-KVTK | 561 |
| WP_000666813 | 488 | SAELFIENLTSRDTYLPDEPVLPKRSLIYQKFTIFNELTKVKYID-EGLTRYqFLDKKQKKDIFDTFFKaeNKR-KVTE | 564 |
| WP_009754323 | 488 | SAESFINKMTNYDLYLPSLLYEKFAVNELTKVKFIA-EGLRDYqFFDSQKKQIVNQLFK--EKR-KVTE | 562 |
| WP_044674937 | 488 | SAENFITRMTNYDQYLPDQKVLPKHSLLYEKFAVNELTKVKYVT-EGMRDYqFLDSQKKQIVKTLFK--TKR-KVTA | 561 |
| WP_044676715 | 487 | SAENFITRMTNYDQYLPDQKVLPKHSLLYEKFAVNELTKVKYVT-EGMRDYqFLDSQKKQIVKTLFK--TKR-KVTA | 560 |
| WP_044680361 | 487 | SAENFITRMTNYDQYLPDQKVLPKHSLLYEKFAVNELTKVRYVT-EQGKSF-FFDANMKQEIFDGVEK--VYR-KVTK | 561 |
| WP_044681799 | 487 | SAENFITRMTNYDQYLPDQKVLPKHSLLYEKFAVNELTKVKFIA-EGMRDYqFLDSQKKDIVKTLFK--TKR-KVTA | 561 |
| WP_049533112 | 472 | SSEAFIKRMTNKCTYLIHEDVIPKHSFSVAKFEVLNELNKIRLDG-----KP--IDIPLKKRIFEGLFL--EKtKVTQ | 540 |
| WP_029909905 | 499 | TAEGFIKRMRSYCTYFPDDEEVLPKNSLIVSKYEVNELFMMIYNELFMM-KNK-TVTE | 567 |
| AIT42264 | 487 | SAQSFIERMTNEDKNLPNEKVLPKDEPVLPKRSLIYQKFTIFNELTKVKVT-ERGILQ-NFSSREKIAIFNDLFK--NKsKVTK | 561 |
| AKQ21048 | 494 | SAELFIENLTSRDTYLSRDTYLPDEPVLPKRSLIYQKFTIFNELTKVKYID-ERGILQ-NFSSREKIAIFNDLFK--NKsKVTK | 567 |
| WP_034440723 | 487 | SAQSFIERMTNFDKNLPNEKVLPKRSLIYQKFTIYNELTKVKVT-EGMRKPaFLSGEQKKAIVDLLFK--TNR-KVTV | 561 |
| WP_004636532 | 489 | SAEKFIERMNDTYLLEEKVLPSEKVLPKRSLLYQTFEVNELTKVKFMV-FNELTKVKYTN-EQGKTE-KLNRQQKAEIIETLFK--qKNR--VRE | 562 |
| WP_002364836 | 496 | SATAFIERMTNFDTYLPSEKVLPKHSLLYEKFAVNELTKVRYTN-DRGIKA-NFSGKEKEKIFDYLFK--TRR-KVKK | 569 |
| WP_016631044 | 447 | SATAFIERMTNFDTYLPSEKVLPKHSLLYEKFMVFNELTKIKSYD-DRGIKA-NFSGKEKEKIFDYLFK--TRR-KVKK | 520 |
| EMS75795 | 232 | SAMKFIQRMLNYDTYLPTEKVLPKHSILYQKYTIFNELTKVKYID-ERGIKH-QFSSKEKREIFKELFQ--KQR-KVTV | 305 |
| WP_002373311 | 496 | SATAFIERMTNFDTYLPSEKVLPKHSLLYEKFMVFNELTKISYTD-DRGIKA-NFSGKEKEKIFDYLFK--TRR-KVKK | 569 |

```
                                                   -continued

WP_002378009  496  SATAFIERMTNFDTYLPSEKVLPKHSLLYEKFMVFNELTKISYTD--DRGIKA-NFSGKEKEKIFDYLFK--TRR-KVKK  569
WP_002407324  496  SATAFIERMTNFDTYLPSEKVLPKHSLLYEKFMVFNELTKISYTD--DRGIKA-NFSGKEKEKIFDYLFK--TRR-KVKK  569
WP_002413717  496  SATAFIERMTNFDTYLPSEKVLPKHSLLYEKFMVFNELTKISYTD--DRGIKA-NFSGKEKEKIFDYLFK--TRR-KVKK  569
WP_010775580  498  SATAFIERMTNFDTYLPSEKVLPKHSLLYEKFMVFNELTKISYTD--DRGIKA-NFSGKEKEKIFDYLFK--TRR-KVKK  571
WP_010818269  496  SATAFIERMTNFDTYLPSEKVLPKHSLLYEKFMVFNELTKISYTD--DRGIKA-NFSGKEKEKIFDYLFK--TRR-KVKK  569
WP_010824395  496  SATAFIERMTNFDTYLPSEKVLPKHSLLYEKFMVFNELTKISYTD--DRGIKA-NFSGKEKEKIFDYLFK--TRR-KVKK  569
WP_016622645  496  SATAFIERMTNFDTYLPSEKVLPKHSLLYEKFMVFNELTKISYTD--DRGIKA-NFSGKEKEKIFDYLFK--TRR-KVKK  569
WP_033624816  496  SATAFIERMTNFDTYLPSEKVLPKHSLLYEKFMVFNELTKISYTD--DRGIKA-NFSGKEKEKIFDYLFK--TRR-KVKK  569
WP_033625576  496  SATAFIERMTNFDTYLPSEKVLPKHSLLYEKFMVFNELTKISYTD--DRGIKA-NFSGKEKEKIFDYLFK--TRR-KVKK  569
WP_033789179  496  SATAFIERMTNFDTYLPSEKVLPKHSLLYEKFMVFNELTKISYTD--DRGIKA-NFSGKEKEKIFDYLFK--TRR-KVKK  569
WP_002310644  493  SAVRFIERMINTDMYMPHNKVLPKNSLLYQKFSIYNELTKVRYQD--ERGQMN-YFSSIEKKEIFHELFE--KNR-KVTK  566
WP_002312694  494  SAVRFIERMINTDMYMPHNKVLPKNSLLYQKFSIYNELTKVRYQD--ERGQMN-YFSSIEKKEIFHELFE--KNR-KVTK  567
WP_002314015  494  SAVRFIERMNNTDMYIPHNKVLPKNSLLYQKFSIYNELTKVRYQD--ERGQMN-YFSSIEKKEIFHELFE--KNR-KVTK  567
WP_002320716  494  SAVRFIERMINTDMYIPHNKVLPKNSLLYQKFSIYNELTKVRYQD--ERGQMN-YFSSIEKKEIFHELFE--KNR-KVTK  567
WP_002330729  493  SAVRFIERMINTDMYIPHNKVLPKNSLLYQKFSIYNELTKVRYQD--ERGQMN-YESSIEKKEIFHELFE--KNR-KVTK  566
WP_002335161  494  SAVRFIERMINTDMYMPHNKVLPKNSLLYQKFSIYNELTKVRYQD--ERGQMN-YESSIEKKEIFHELFE--KNR-KVTK  567
WP_002345439  494  SAVRFIERMINTDMYIPHNKVLPKNSLLYQKFSIYNELTKVRYQD--ERGQMN-YESSIEKKEIFHELFE--KNR-KVTK  567
WP_034867970  487  SAMRFIQRMTKQDTYLPTEKVLPKNSLLYQKYMIFNELTKVSYKD--ERGVKQ-YFSGDEKQQIFKQLFQ--KERgKITV  561
WP_047937432  494  SAVRFIERMINTDMYMPHNKVLPKNSLLYQKFSIYNELTKVRYQD--ERGQMN-YESSIEKKEIFHELFE--KNR-KVTK  567
WP_010720994  487  SAMRFIQRMKQDTYLPTEKVLPKNSLLYQKYMIFNELTKVSYKD--ERGVKQ-YFSGDEKQQIFKQLFQ--KERgKITV  561
WP_002314015  487  SAMRFIQRMKQDTYLPTEKVLPKNSLLYQKYMIFNELTKVSYKD--ERGVKQ-YFSGDEKQQIFKQLFQ--KERgKITV  561
WP_010737004  491  SAVAFIERMTIKDIYL-NENVLPRHSLLIYEKFTVFNELTKVLYAD--DRGVFQ-RFSAEBKEDIFEKLFK--SER-KVTK  563
WP_034700478  487  SAIEFIERMTNQDTYLPKEKVLPKQSLLIYQRYEVLNELTKVSYTD--ERGKSH-YFSSEQKRKIFNELFK--QHP-RVTE  559
WP_007209903  486  SATKFIERMTNEDTYLPTEKVLPKHSMIYEKYMVTNELTKVSYVD--ERGMNQ-RFSGGKVEELFK--QSR-KVTK  563
WP_025519017  487  SAELFIERMTNFDLYLPSEKVLPTEKVLPKHSMLYQKYTIFNELTKVAYKD--EQGKVQ-NFSSEEKERIFIDLFK--QHR-KVTK  559
WP_048604708  487  SATKFIQRMINYDTYLPTEKVLPKHSLPKYSMLYQKYTIFNELTKVSYVD--DRGIKH-QFSSEEKLRIFQELFK--KQR-RVTK  560
WP_010750235  526  SAQSFIERMTNFDKNLPNEKVLPKHSLLYEYFTVNELTKVKVT--EGMRKPaFLSGEQKKAIVDLFK--TNR-KVTV  600
AII16583      507  TADEFIKRMRMFCTYFPDEPVLAKNSLTVSKYEVLNEINKLRIND-----------hLIKRDIKDKMLHTLFM--DHK-SISA  575
WP_029073316  507  TADEFIKRMRMFCTYFPDEPVLAKNSLTVSKYEVLNEINKLRIND-----------hLIKRDIKDKMLHTLFM--DHK-SISA  575
WP_031589969  485  SAEDFIKRMTINDLYLPTEPVLPKHSLLYERYTIFNELAGVRYVT--ENGEAK-YFDAQTKRSIFE-LFKl--DR-KVSE  557
KDA45870      510  SANEFIKRMTTDTYLLAEDVLPKENVLPKHSLLYQKYTIFNELAGVRYVT--QPITTE---LKQAIFTDLFM--QKtSVTV  578
WP_039099354  484  SSNKFIRRMVTDSLVGEPVLPKHSLLIYQRYEVLNELANNIRITEnlKTNPTGsRLTVETKQHIYNELFK--NYK-KITV  560
AKP02966      493  SAVDFIEKMTNKDTYLPKENVLPKHSLCYQKYLVVNELTKVRYIN--DQGKTS-YFSGQEKEQIFNDLFK--QKR-KVKK  566
WP_010991369  493  SAVDFIEKMTNKDTYLPKENVLPKHSLCYQKYLVVNELTKVRYIN--DQGKTS-YFSGQEKEQIFNDLFK--QKR-KVKK  566
WP_033838504  262  SAVDFIEKMTNKDTYLPKENVLPKHSLCYQKYLVVNELTKVRYIN--DQGKTS-YFSGQEKEQIFNDLFK--QKR-KVKK  335
EHN60060      493  SAVDFIEKMTNKDTYLPKENVLPKHSLCYQKYLVVNELTKVRYIN--DQGKTS-YFSGQEKEQIFNDLFK--QKR-KVKK  566
EFR89594      112  SAIDFIEKMTNKDTYLPKENVLPKHSLCYQKYMVYNELTKIRYID--DQGKTH-HFSGQEKQQIFNGLFK--QQR-KVKK  185
WP_038409211  493  SAIDFIEKMTNKDTYLPKENVLPKHSLCYQKYMVYNELTKIRYID--DQGKTH-HFSGQEKQQIFNGLFK--QQR-KVKK  566
EFR95520      493  SAVDFIEKMTNKDTYLPKENVLPKHSLCYQKYMVYNELTKIRYID--DQGKTN-YFSGQEKQQVFNDLFK--QQR-KVKK  566
WP_003723650  493  SAVDFIEKMTNKDTYLPKENVLPKHSLCYQKYMVYNELTKIRYID--DQGKTN-YFSGQEKQQIFNDLFK--QKR-KVKK  566
WP_003727705  493  SAVDFIEKMTNKDTYLPKENVLPKHSLCYQKYMVYNELTKIRYID--DQGKTN-YFSGQEKQQIFNDLFK--QKR-KVKK  566
WP_003730785  493  SAVDFIEKMTNKDTYLPKENVLPKHSLCYQKYMVYNELTKIRYID--DQGKTN-YFSGQEKQQIFNDLFK--QKR-KVKK  566
WP_003733029  493  SAVDFIEKMTNKDTYLPKENVLPKHSLCYQKYMVYNELTKIRYID--DQGKTN-YFSGQEKQQIFNDLFK--QKR-KVKK  566
WP_003739838  493  SAVDFIEKMTNKDTYLPKENVLPKHSLCYQKYMVYNELTKIRYID--DQGKTN-YFSGQEKQQIFNDLFK--QKR-KVSK  566
WP_014601172  493  SAVDFIEKMTNKDTYLPKENVLPKHSLCYQKYMVYNELTKIRYID--DQGKTN-YFSGQEKQQIFNDLFK--QKR-KVKK  566
WP_023548323  493  SAVDFIEKMTNKDTYLPKENVLPKHSLCYQKYMVYNELTKIRYID--DQGKTN-YFSGREKQQIFNDLFK--QKR-KVKK  566
WP_031665337  493  SAVDFIEKMTNKDTYLPKENVLPKHSLCYQKYMVYNELTKIRYID--DQGKTN-YFSGQEKQQIFNDLFK--QKR-KVKK  566
WP_031669209  493  SAVDFIEKMTNKDTYLPKENVLPKHSLCYQKYMVYNELTKIRYID--DQGKTN-YFSGQEKQQIFNDLFK--QKR-KVKK  566
WP_033920898  493  SAVDFIEKMTNKDTYLPKENVLPKHSLCYQKYMVYNELTKIRYID--DQGKTN-YFSGQEKQQIFNDLFK--QKR-KVKK  566
AKI42028      496  SAVDFIEKMTNKDTYLPKENVLPKHSLCYQKYMVYNELTKIRYID--DQGKTN-YFSGQEKQQIFNDLFK--QKR-KVKK  569
AKI50529      496  SAVDFIEKMTNKDTYLPKENVLPKHSLCYQKYMVYNELTKIRYID--DQGKTN-YFSGQEKQQIFNDLFK--QKR-KVKK  569
EFR83390        1  -----------------------------------------------------------IFNDLFK--QKR-KVKK  14
WP_046322366  493  SAIDFIEKMTNKDTYLPKHSMCYQKYMVYNELTKIRYTD--DQGKTH-YFSGQEKQQIENDLFK--QKR-KVKK  566
AKE81011      503  SAQSPIERMTNFDKNLPNEKVLPKHSLLYEYFTVNELTKVKVT--EGMRKPaFLSGEQKKAIVDLLFK--TNR-KVTV  577
```

```
                                             -continued

CUO82355          503 TAEGFIKRMRSYCYFPDEVLPKNSLIVSKYEVYNELNKIRVDD------kLLEVDVKNDIYNELFM--KNK-TVTE     571
WP_033162887      504 TAEGFIERMKNTGYFPDEPVMAKNSLTVSKFEVLNELNKIRING------kLIAVETKKELLSDLFM--KNK-TITD     572
AGZ01981          520 SAQSFIERMTNFDKNLPNEKVLPKHSLLYEYFTVNELTKVKYVT--EGMRKPaFLSGEQKKAIVDLLFK--TNR-KVTV     594
AKA60242          487 SAQSFIERMTNFDKNLPNEKVLPKHSLLYEYFTVNELTKVKYVT--EGMRKPaFLSGEQKKAIVDLLFK--TNR-KVTV     561
AKS40380          487 SAQSFIERMTNFDKNLPNEKVLPKHSLLYEYFTVNELTKVKYVT--EGMRKPaFLSGEQKKAIVDLLFK--TNR-KVTV     561
4UN5_B            491 SAQSFIERMTNFDKNLPNEKVLPKHSLLYEYFTVNELTKVKYVT--EGMRKPaFLSGEQKKAIVDLLFK--TNR-KVTV     565

WP_010922251      562 KQLKEDYFKK--IECFDSVEISGVEDR---FNASLGTYHDLLKIIKDK  DFLDNEENEDILEDIVLTLTLFEDREMIE     633
WP_039695303      564 EKLLNYLNKE--FPEYRIKDLIGLDKEhkSFNASLGTYHDLKKLL-DK  AFLDDKVNEEVIEDIIKTLTLFEDKDMIH     637
WP_045635197      562 KDIIHYLHN---VDGYDGIELKGIEKQ--FNASLSTYHDLLKILKDD-  EFMDDAKNEAILENIVHTLITFEDREMIE     632
5AXW_A            300 KQIAKEILVNe-EDIKGYRVTSTGKPe--FTNLKVYHDIKDITARK    ------ENAELLDQIAKLITIYQSSEDIQ   368
WP_009800683      246 KQLKEDYFKK--IECFDSVEISGVEDR---FNTSLGTYHDLLKIIKDK  DFLDNEENEDILEDIVLTLTLFEDKEMIE     317
WP_010922251      562 KQLKEDYFKK--IECFDSVEISGVEDR---FNASLGTYHDLLKIIKDK  DFLDNEENEDILEDIVLTLTLFEDREMIE     633
WP_011054416      562 KQLKEDYFKK--IECFDSVEISGVEDR---FNASLGTYHDLLKIIKDK  DFLDNEENEDILEDIVLTLTLFEDREMIE     633
WP_011284745      562 KQLKEDYFKK--IECFDSVEISGVEDR---FNASLGTYHDLLKIIKDK  DFLDNEENEDILEDIVLTLTLFEDREMIE     633
WP_011285506      562 KQLKEDYFKK--IECFDSVEISGVEDR---FNASLGTYHDLLKIIKDK  DFLDNEENEDILEDIVLTLTLFEDREMIE     633
WP_011527619      562 KQLKEDYFKK--IECFDSVEISGVEDR---FNASLGTYHDLLKIIKDK  DFLDNEENEDILEDIVLTLTLFEDREMIE     633
WP_012560673      562 KQLKEDYFKK--IECFDSVEISGVEDR---FNASLGTYHDLLKIIKDK  DFLDNEENEDILEDIVLTLTLFEDREMIE     633
WP_014407541      562 KQLKEDYFKK--IECFDSVEISGVEDR---FNASLGAYHDLLKIIKDK  DFLDNEENEDILEDIVLTLTLFEDRGMIE     633
WP_020905136      562 KQLKEDYFKK--IECFDSVEISGVEDR---FNTSLGTYHDLLKIIKDK  DFLDNEENEDILEDIVLTLTLFEDREMIE     633
WP_023080005      562 KQLKEDYFKK--IECFDSVEISGVEDR---FNASLGTYHDLLKIIKDK  DFLDNEENEDILEDIVLTLTLFEDKEMIE     633
WP_023610282      562 KQLKEDYFKK--IECFDSVEISGVEDR---FNASLGTYHDLLKIIKDK  DFLDNEENEDILEDIVLTLTLFEDREMIE     633
WP_030125963      562 KQLKEDYFKK--IECFDSVEISGVEDR---FNASLGTYHDLLKIIKDK  DFLDNEENEDILEDIVLTLTLFEDREMIE     633
WP_030126706      562 KQLKEDYFKK--IECFDSVEISGVEDR---FNASLGTYHDLLKIIKDK  DFLDNEENEDILEDIVLTLTLFEDREMIE     633
WP_031488318      562 KQLKEDYFKK--IECFDSVEISGVEDR---FNASLGTYHDLLKIIKDK  DFLDNEENEDILEDIVLTLTLFEDREMIE     633
WP_032460140      562 KQLKEDYFKK--IECFDSVEISGVEDR---FNASLGTYHDLLKIIKDK  DFLDNEENEDILEDIVLTLTLFEDREMIE     633
WP_032461047      562 KQLKEDYFKK--IECFDSVEISGVEDR---FNASLGTYHDLLKIIKDK  DFLDNEENEDILEDIVLTLTLFEDREMIE     633
WP_032462016      562 KQLKEDYFKK--IECFDSVEISGVEDR---FNASLGTYHDLLKIIKDK  DFLDNEENEDILEDIVLTLTLFEDREMIE     633
WP_032462936      562 KQLKEDYFKK--IECFDSVEISGVEDR---FNASLGTYHDLLKIIKDK  DFLDNEENEDILEDIVLTLTLFEDREMIE     633
WP_032464890      562 KQLKEDYFKK--IECFDSVEISGVEDR---FNASLGTYHDLLKIIKDK  DFLDNEENEDILEDIVLTLTLFEDREMIE     633
WP_033888930      387 KQLKEDYFKK--IECFDSVEISGVEDR---FNTSLGTYHDLLKIIKDK  DFLDNEENEDILEDIVLTLTLFEDREMIE     458
WP_038431314      562 KQLKEDYFKK--IECFDSVEISGVEDR---FNASLGTYHDLLKIIKDK  DFLDNEENEDILEDIVLTLTLFEDREMIE     633
WP_038432938      562 KQLKEDYFKK--IECFDSVEISGVEDR---FNASLGTYHDLLKIIKDK  DFLDNEENEDILEDIVLTLTLFEDREMIE     633
WP_038434062      473 KQLKEDYFKK--IECFDSVEISGVEDR---FNASLGTYHDLLKIIKDK  DFLDNEENEDILEDIVLTLTLFEDREMIE     544
BAQ51233              ------------------------------------------------  ------------------------------
KGE60162              ------------------------------------------------  ------------------------------
KGE60856          562 KQLKEDYFKK--IECFDSVEISGVEDR---FNASLGTYHDLLKIIKDK  DFLDNEENEDILEDIVLTLTLFEDREMIE     633
WP_002989955      561 DKLLNYLNKE--FEEFRIVNLTGLDKEhkAFNSSLGTYHDLLRKLL-DK SFLDDKANEKTIEDIIQTLTLFEDREMIR     634
WP_003030002      564 EKLLNYLNKE--FPEYRIKDLIGLDKEhkSFNASLGTYHDLKKLL-DK  AFLDDKVNEEVIEDIIKTLTLFEDKDMIH     637
WP_003065552      563 KDIISFLNK---VDGYEGIAIKGIEKQ--FNASLGTYHDLKKLL-GK   DFLDNTNDNELIEDIVQTLTLFEDREMIK     632
WP_001040076      562 KKLLDFLAKE--YEEFRIVDVIGLDKEhkAFNASLGTYHDLLEKLL-DK DFLDNPDNESILEDIVQTLTLFEDREMIK     635
WP_001040078      562 KKLLDFLAKE--YEEFRIVDVIGLDKEhkAFNASLGTYHDLLEKLL-DK DFLDNPDNESILEDIVQTLTLFEDREMIK     635
WP_001040080      562 KKLLDFLAKE--YEEFRIVDVIGLDKEhkAFNASLGTYHDLLEKLL-DK DFLDNPDNESILEDIVQTLTLFEDREMIK     635
WP_001040081      562 KKLLDFLAKE--YEEFRIVDVIGLDKEhkAFNASLGTYHDLLEKLL-DK DFLDNPDNESILEDIVQTLTLFEDREMIK     635
WP_001040083      562 KKLLDFLAKE--YEEFRIVDVIGLDKEhkAFNASLGTYHDLLEKLL-DK DFLDNPDNESILEDIVQTLTLFEDREMIK     635
WP_001040085      562 KKLLDFLAKE--YEEFRIVDVIGLDKEhkAFNASLGTYHDLLEKLL-DK DFLDNPDNESILEDIVQTLTLFEDREMIK     635
WP_001040087      562 KKLLDFLAKE--YEEFRIVDVIGLDKEhkAFNASLGTYHDLLEKLL-DK DFLDNPDNESILEDIVQTLTLFEDREMIK     635
WP_001040088      562 KKLLDFLAKE--YEEFRIVDVIGLDKEhkAFNASLGTYHDLLEKLL-DK DFLDNPDNESILEDIVQTLTLFEDREMIK     635
WP_001040089      562 KKLLDFLAKE--YEEFRIVDVIGLDKEhkAFNASLGTYHDLLEKLL-DK DFLDNPDNESILEDIVQTLTLFEDREMIK     635
WP_001040090      562 KKLLDFLAKE--YEEFRIVDVIGLDKEhkAFNASLGTYHDLLEKLL-DK DFLDNPDNESILEDIVQTLTLFEDREMIK     635
WP_001040091      562 KKLLDFLAKE--FEEFRIVDVTGLDKEhkAFNASLGTYHDLLEKLL-DK DFLDNPDNESILEDIVQTILFEDREMIK     635
WP_001040092      562 KQLKEDYFKK--IECFDSVEISGVEDR---FNASLSTYHDLKKLL-GK  DFLDNPDNESILEDIVQTLTLFEDREMIK     635
WP_001040094      563 KDIISFLNK---VDGYEGIAIKGIEKQ--FNASLSTYHDLKKLL-GK   DFLDNTNELIEDIVQTLTLFEDREMIR     632
```

```
WP_001040095   563  KDIISFLNK---VDGYEGIAIKGIEKQ---FNASLSTYHDLKKIL-GK   FLDNTDNELILEDIVQTLFEDREMIR  632
WP_001040096   563  KDIISFLNK---VDGYEGIAIKGIEKQ---FNASLSTYHDLKKIL-GK   DFLDNTDNELILEDIVQTLFEDREMIR  632
WP_001040097   563  KDIISFLNK---VDGYEGIAIKGIEKQ---FNASLSTYHDLKKIL-GK   DFLDNTDNELILEDIVQTLFEDREMIR  632
WP_001040098   563  KDIISFLNK---VDGYEGIAIKGIEKQ---FNASLSTYHDLKKIL-GK   DFLDNTDNELILEDIVQTLFEDREMIR  632
WP_001040099   563  KDIISFLNK---VDGYEGIAIKGIEKQ---FNASLSTYHDLKKIL-GK   DFLDNTDNELILEDIVQTLFEDREMIR  632
WP_001040100   563  KDIISFLNK---VDGYEGIAIKGIEKQ---FNASLSTYHDLKKIL-GK   DFLDNTDNELILEDIVQTLFEDREMIR  632
WP_001040104   562  KKLLDFLAKE--YEEFRIVDVIGLDKEHKAFNASLGTYHDLKKIL-DK   DFLDNPDNESILEDIVQTLFEDREMIK  635
WP_001040105   562  KKLLDFLAKE--YEEFRIVDVIGLDKEHKAFNASLGTYHDLKKIL-DK   DFLDNPDNESILEDIVQTLFEDREMIK  635
WP_001040106   562  KKLLDFLAKE--YEEFRIVDVIGLDKEHKAFNASLGTYHDLKKIL-DK   DFLDNPDNESILEDIVQTLFEDREMIK  635
WP_001040107   562  KKLLDFLAKE--YEEFRIVDVIGLDKEHKAFNASLGTYHDLKKIL-DK   DFLDNPDNESILEDIVQTLFEDREMIK  635
WP_001040108   562  KKLLDFLAKE--YEEFRIVDVIGLDKEHKAFNASLGTYHDLKKIL-DK   DFLDNPDNESILEDIVQTLFEDREMIK  635
WP_001040109   562  KKLLDFLAKE--YEEFRIVDVIGLDKEHKAFNASLGTYHDLKKIL-DK   DFLDNPDNESILEDIVQTLFEDREMIK  635
WP_001040110   562  KKLLDFLAKE--YEEFRIVDVIGLDKEHKAFNASLGTYHDLKKIL-DK   DFLDNTDNESILEDIVQTLFEDREMIK  635
WP_015058523   563  KQLLDFLAKE--FEEFRIVDVIGLDKEHKAFNASLGTYHDLKKIL-GK   DFLDNPDNESILEDIVQTLFEDREMIK  635
WP_017643650   563  KDIISFLNK---VDGYEGIAIKGIEKQ---FNASLSTYHDLKKIL-GK   DFLDNPDNESILEDIVQTLFEDREMIK  632
WP_017647151   562  KKLLDFLAKE--YEEFRIVDVIGLDKEHKAFNASLGTYHDLKKIL-DK   DFLDNPDNESILEDIVQTLFEDREMIK  635
WP_017648376   562  KKLLDFLAKE--YEEFRIVDVIGLDKEHKAFNASLGTYHDLKKIL-DK   DFLDNPDNESILEDIVQTLFEDREMIK  635
WP_017649527   562  KKLLDFLAKE--YEEFRIVDVIGLDKEHKAFNASLGTYHDLKKIL-DK   DFLDNPDNESILEDIVQTLFEDREMIK  635
WP_017771611   562  KKLLDFLAKE--YEEFRIVDVIGLDKEHKAFNASLGTYHDLKKIL-DK   DFLDNPDNESILEDIVQTLFEDREMIK  635
WP_017771984   562  KKLLDFLAKE--YEEFRIVDVIGLDKEHKAFNASLGTYHDLKKIL-DK   DFLDNPDNESILEDIVQTLFEDREMIK  635
CFQ25032       562  KKLLDFLAKE--YEEFRIVDVIGLDKEHKAFNASLGTYHDLKKIL-DK   DFLDNPDNESILEDIVQTLFEDREMIK  635
CFV16040       562  KKLLDFLAKE--YEEFRIVDVIGLDKEHKAFNASLGTYHDLKKIL-DK   DFLDNPDNESILEDIVQTLFEDREMIK  635
KLJ37842       562  KKLLDFLAKE--YEEFRIVDVIGLDKEHKAFNASLGTYHDLEKIL-DK   DFLDNPDNESILEDIVQTLFEDREMIK  635
KLJ72361       562  KKLLDFLAKE--YEEFRIVDVIGLDKEHKAFNASLGTYHDLEKIL-DK   DFLDNPDNESILEDIVQTLFEDREMIK  635
KLL20707       563  KDIISFLNK---VDGYEGIAIKGIEKQ---FNASLSTYHDLKKIL-GK   DFLDNPDNESILEDIVQTLFEDREMIK  632
KLL42645       562  KKLLDFLAKE--YEEFRIVDVIGLDKEHKAFNASLGTYHDLEKIL-DK   DFLDNPDNESILEDIVQTLFEDREMIK  635
WP_047207273   562  KKLLDFLAKE--YEEFRIVDVIGLDKEHKAFNASLGTYHDLEKIL-DK   DFLDNPDNESILEDIVQTLFEDREMIK  635
WP_047209694   563  KDIISFLNK---VDGYEGIAIKGIEKQ---FNASLSTYHDLKKIL-GK   DFLDNPDNESILEDIVQTLFEDREMIK  632
WP_050198062   562  KKLLDFLAKE--YEEFRIVDVIGLDKEHKAFNASLGTYHDLKKIL-DK   DFLDNPDNESILEDIVQTLFEDREMIK  635
WP_050201642   562  KKLLDFLAKE--YEEFRIVDVIGLDKEHKAFNASLGTYHDLKKIL-DK   DFLDNPDNESILEDIVQTLFEDREMIK  635
WP_050204027   562  KKLLDFLAKE--YEEFRIVDVIGLDKEHKAFNASLGTYHDLKKIL-DK   DFLDNPDNESILEDIVQTLFEDREMIK  635
WP_050881965   562  KKLLDFLAKE--YEEFRIVDVIGLDKEHKAFNASLGTYHDLEKIL-DK   DFLDNPDNESILEDIVQTLFEDREMIK  635
WP_050886065   562  KKLLDFLAKE--YEEFRIVDVIGLDKEHKAFNASLGTYHDLKKIL-DK   DFLDNPDNESILEDIVQTLFEDREMIK  635
AHN30376       562  KQLLDFLAKE--FEEFRIVDVTGLDKEHKAFNASLGTYHDLKKIL-DK   DFLDNPDNESILEDIVQTLFEDREMIK  635
EAO78426       562  KQLLDFLAKE--YEEFRIVDVTGLDKEHKAFNASLGTYHDLEKIL-GK   DFLDNPDNESILEDIIQTLFEDREMIK  635
CCW42055       562  DKLLNYLNKE--FEEFRIVNLTGLDKEHKVENSSLGTYHDLRKIL-NK   SFLDNKENAQIIEDIIQTLTLFEDREMIK  634
WP_003041502   562  DKLLNYLNKE--FEEFRIVNLTGLDKEHKAENSSLGTYHDLRKIL-DK   SFLDDKANEKTIEDIIQTLTLFEDREMIK  635
WP_037593752   561  DKLLNYLNKE--FEEFRIVNLTGLDKEHKAENSSLGTYHDLRKIL-DK   SFLDDKVNEKIIEDIIQTLTLFEDREMIR  635
WP_049516684   562  DKLLNYLNKE--FEEFRIVNLTGLDKEHKAENSSLGTYHDLRKIL-DK   SFLDDKVNEKIIEDIIQTLTLFEDREMIR  635
GAD46167       561  EKLLNYLDKE--FPEYRIQDLVGLDKEHKSFNASLGTYHDLLKKIL-DK   SFLDDKVNEEVIEDIIKTLTLFEDREMIQ  634
WP_003443819   572  KQLKEDYFKK--IECFDSVEISGVEDR---FNASLGTYHDLLKKIL-DK   DFLDNEENEDILEDIVLTLTLFEDKEMIE  643
WP_006269658   561  DKLLNYLNKE--FEEFRIVDLTGLDKEHKAENSSLGTYHDLRKIL-DK   SFLDDKANEKTIEDIIQTLTLFEDREMIK  634
WP_048800889   562  KQLKEDYFKK--IECFDSVEISGVEDR---FNASLGTYHDLLKKIL-DK   SFLDNEENEDILEDIVLTLTLFEDREMIK  634
WP_012767106   562  KQLKEDYFKK--IECFDSVEISGVEDR---FNASLGTYHDLLKKIL-DK   DFLDNEENEDILEDIVLTLTLFEDKEMIE  635
WP_014612333   562  KQLKEDYFKK--IECFDSVEISGVEDR---FNASLGTYHDLLKKIL-DK   DFLDNEENEDILEDIVLTLTLFEDKEMIE  635
WP_015017095   562  KQLKEDYFKK--IECFDSVEISGVEDR---FNASLGTYHDLLKKIL-DK   DFLDNEENEDILEDIVLTLTLFEDKEMIE  635
WP_015057649   562  KQLKEDYFKK--IECFDSVEISGVEDR---FNASLGTYHDLLKKIL-DK   DFLDNEENEDILEDIVLTLTLFEDKEMIE  635
WP_048277215   562  KQLKEDYFKK--IECFDSVEISGVEDR---FNASLGTYHDLLKKIL-DK   DFLDNEENEDILEDIVLTLTLFEDKEMIE  635
WP_049519324   562  KQLKENYFKK--IECFDSVEISGVEDS---FNASLGTYHDLLKKIL-DK   DFLDNPDNQKIIEDIILTLTLFEDKKMIS  633
WP_012515931   562  KQLKENYFKK--IECWDSVEITGVEDS---FNASLGTYHDLLKIQDK   DFLDNPDNQKIIEDIILTLTLFEDKKMIS  633
WP_021320964   562  KQLKENYFKK--IECWDSVEITGVEDS---FNASLGTYHDLLKIQDK   DFLDNPDNQKIIEDIILTLTLFEDKKMIS  633
WP_037581760   562  KQLKENYFKK--IECWDSVEITGVEDS---FNASLGTYHDLLKIQDK   DFLDNPDNQKIIEDIILTLTLFEDKKMIS  633
WP_004232481   561  AKLLSYLNNE--FEEFRINDLIGLDKDSKSFNASLGTYHDLLKKIL-DK   SFLDDKTNEQIIEDIVLTLTLFEDRDMIH  634
```

```
WP_009854540  562  EKLLNYLNKE--FPEYRIKDLIGLDKEnkSFNASLGTYHDLKKLL-DK  AFLDDKVNEEVIEDIIKTLTLFEDKDMIH  635
WP_012962174  562  DKFLNYLNKE--FPEYRIQDLIGLDKEnkSFNASLGTYHDLKKLL-DK  SFLDDKTNETIIEDIIQTLTLFEDRDMIR  635
WP_039695303  564  EKLLNYLNKE--FPEYRIKDLIGLDKEnkSFNASLGTYHDLKKLL-DK  AFLDDKVNEEVIEDIIKTLTLFEDKDMIH  637
WP_014334983  561  AKLLSYLNNE--FEEFRINDLIGLDKDskSFNASLGTYHDLKKLL-DK  SFLDDKTNGQILEDIVLTLTLFEDRDMIH  633
WP_003099269  562  KQLKEEYESK--MKCFHTVTILGVEDR---FNASLGTYHDLLKIFKDK  AFLDDEANQDILEEIVWTLTLFEDQAMIE  633
AHY15608      562  KQLKEEYESK--MKCFHTVTILGVEDR---FNASLGTYHDLLKIFKDK  AFLDDEANQDILEEIVWTLTLFEDQAMIE  633
AHY17476           KQLKEEYESK--MKCFHTVTILGVEDR---FNASLGTYHDLLKIFKDK  AFLDDEANQDILEEIVWTLTLFEDQAMIE
ESR09100           ------------------------------------------------  -----------------------------
AGM98575      562  KQLKEEYESK--MKCFHTVTILGVEDR---FNASLGTYHDLLKIFKDK  AFLDDEANQDILEEIVWTLTLFEDQAMIE  633
ALF27331      561  DKLMDFLEKE--FDEFRIVDLTGLDKEnkAFNASYGTYHDLCKLL-DK  DFLDNSKNEKILEDIVLTLTLFEDREMIR  634
WP_018372492  574  RKLLKDFIEKElgYGYIDIDNIKGVEEQ--FNASYTTYQDLLKIIGDK  EFLDNEENKDLLEEIYILTVFEDRKMIE   647
WP_045618028  563  KDIIQYLHN---VDSYDGIELKGIEKQ---FNASLSTYHDLLKIIKDK  EFMDDSKNEAILENIVHTLTIFEDREMIK  633
WP_045635197  562  KDIIHYLHN---VDGYDGIELKGIEKQ---FNASLSTYHDLLKIIKDK  EFMDDAKNEAILENIVHTLTLFEDREMIK  632
WP_002263549  561  DKLMDFLEKE--FDEFRIVDLTGLDKEnkVFNASYGTYHDLCKLL-DK  DFLDNSKNEKILEDIVLTLTLFEDREMIR  634
WP_002263887  561  DKLMDFLEKE--FDEFRIVDLTGLDKEnkVFNASYGTYHDLCKLL-DK  DFLDNSKNEKILEDIVLTLTLFEDREMIR  634
WP_002264920  561  DKLMDFLEKE--FDEFRIVDLTGLDKEnkAFNASYGTYHDLCKLL-DK  DFLDNSKNEKILEDIVLTLTLFEDREMIR  634
WP_002269043  561  DKLMDFLEKE--FDEFRIVDLTGLDKEnkAFNASYGTYHDLRKLL-DK  DFLDNSKNEKILEDIVLTLTLFEDREMIR  634
WP_002269448  561  DKLMDFLEKE--FDEFRIVDLTGLDKEnkAFNASYGTYHDLRKLL-DK  DFLDNSKNEKILEDIVLTLTLFEDREMIR  634
WP_002271977  561  DKLMDFLEKE--FDEFRIVDLTGLDKEnkAFNASYGTYHDLCKLL-DK  DFLDNSKNEKILEDIVLTLTLFEDREMIR  634
WP_002272766  561  DKLMDFLEKE--FDEFRIVDLTGLDKEnkAFNASYGTYHDLRKLL-DK  DFLDNSKNEKILEDIVLTLTLFEDREMIR  634
WP_002273241  561  DKLMDFLEKE--FDEFRIVDLTGLDKEnkAFNASYGTYHDLRKLL-DK  DFLDNSKNEKILEDIVLTLTLFEDREMIR  634
WP_002275430  561  DKLMDFLEKE--FDEFRIVDLTGLDKEnkAFNASYGTYHDLRKLL-DK  DFLDNSKNEKILEDIVLTLTLFEDREMIR  634
WP_002276448  561  DKLMDFLEKE--FDEFRIVDLTGLDKEteTFNASYGTYHDLRKLL-DK  DFLDNSKNEKILEDIVLTLTLFEDREMIR  634
WP_002277050  561  DKLMDFLEKE--FDEFRIVDIQGLDKEteTFNASYGTYQDLLKVIKDK  VFMDNPENAEILENIVLTLTLFEDREMIR  635
WP_002277364  561  KKLRTFLDKN--FDEFRIVDLTGLDKEnkAFNASYGTYHDLRKLL-DK  DFLDNSKNEKILEDIVLTLTLFEDREMIR  634
WP_002279025  561  DKLMDFLEKE--FDEFRIVDLTGLDKEnkAFNASYGTYHDLRKLL-DK  DFLDNSKNEKILEDIVLTLTLFEDREMIR  634
WP_002279859  561  DKLMDFLEKE--FDEFRIVDLTGLDKEnkAFNASYGTYHDLCKLL-DK  DFLDNSKNEKILEDIVLTLTLFEDREMIR  634
WP_002280230  561  DKLMDFLEKE--FDEFRIVDLTGLDKEnkAFNASYGTYHDLCKLL-DK  DFLDNSKNEKILEDIVLTLTLFEDREMIR  634
WP_002281696  561  DKLMDFLEKE--FDEFRIVDLTGLDKEnkAFNASYGTYHDLRKLL-DK  DFLDNSKNEKILEDIVLTLTLFEDREMIR  634
WP_002282247  561  KKLRTFLDKN--FDEFRIVDIQGLDKEteTFNASYATYQDLLKVIKDK  VFMDNPENAEILENIVLTLTLFEDREMIK  635
WP_002282906  561  DKLMDFLEKE--FDEFRIVDLTGLDKEnkAFNASYGTYHDLCKLL-DK  DFLDNSKNEKILEDIVLTLTLFEDREMIR  634
WP_002283846  561  DKLMDFLEKE--FDEFRIVDLTGLDKEnkAFNASYGTYHDLRKLL-DK  DFLDNSKNEKILEDIVLTLTLFEDREMIR  634
WP_002287255  561  DKLMDFLEKE--FDEFRIVDLTGLDKEnkAFNASYGTYHDLRKLL-DK  DFLDNSKNEKILEDIVLTLTLFEDREMIR  634
WP_002288990  561  DKLMDFLEKE--FDEFRIVDLTGLDKEnkAFNASYGTYHDLRKLL-DK  DFLDNSKNEKILEDIVLTLTLFEDREMIR  634
WP_002289641  561  DKLMDFLEKE--FDEFRIVDLTGLDKEnkAFNASYGTYHDLRKLL-DK  DFLDNSKNEKILEDIVLTLTLFEDREMIR  634
WP_002290427  571  DKLLNYLNKE--FEEFRIVDLTGLDKEnkVENSSLGTYHDLRKLL-NK  SFLDNKENEQIIEDIIQTLTLFEDREMIR  644
WP_002295753  561  DKLMDFLEKE--FDEFRIVDLTGLDKEnkAFNASYGTYHDLCKLL-DK  DFLDNSKNEKILEDIVLTLTLFEDREMIR  634
WP_002296423  561  DKLMDFLEKE--FDEFRIVDLTGLDKEnkAFNASYGTYHDLRKLL-DK  DFLDNSKNEKILEDIVLTLTLFEDREMIR  634
WP_003044487  561  DKLMDFLEKE--FDEFRIVDLTGLDKEnkAFNASYGTYHDLRKLL-DK  DFLDNSKNEKILEDIVLTLTLFEDREMIR  634
WP_002305844  561  DKLMDFLEKE--FDEFRIVDLTGLDKEnkAFNASYGTYHDLRKLL-DK  DFLDNSKNEKILEDIVLTLTLFEDREMIR  634
WP_002307203  561  DKLMDFLEKE--FDEFRIVDLTGLDKEnkAFNASYGTYHDLRKLL-DK  DFLDNSKNEKILEDIVLTLTLFEDREMIR  634
WP_002310390  561  DKLMDFLEKE--FDEFRIVDLTGLDKEnkAFNASYGTYHDLRKLL-DK  DFLDNSKNEKILEDIVLTLTLFEDREMIR  634
WP_002352408  561  DKLMDFLEKE--FDEFRIVDLTGLDKEnkAFNASYGTYHDLRKLL-DK  DFLDNSKNEKILEDIVLTLTLFEDREMIR  634
WP_012997688  561  DKLMDFLEKE--FDEFRIVDLTGLDKEnkAFNASYGTYHDLRKLL-DK  DFLDNSKNEKILEDIVLTLTLFEDREMIR  634
WP_014677909  561  DKLMDFLEKE--FDEFRIVDLTGLDKEnkAFNASYGTYHDLRKLL-DK  DFLDNSKNEKILEDIVLTLTLFEDREMIR  634
WP_019312892  561  DKLMDFLEKE--FDEFRIVDLTGLDKEnkAFNASYGTYHDLCKLL-DK  DFLDNSKNEKILEDIVLTLTLFEDREMIR  634
WP_019313659  561  DKLMDFLEKE--FDEFRIVDLTGLDKEnkAFNASYGTYHDLRKLL-DK  DFLDNSKNEKILEDIVLTLTLFEDREMIR  634
WP_019314093  561  DKLMDFLEKE--FDEFRIVDLTGLDKEnkAFNASYGTYHDLRKLL-DK  DFLDNSKNEKILEDIVLTLTLFEDREMIR  634
WP_019315370  561  DKLMDFLEKE--FDEFRIVDLTGLDKEnkAFNASYGTYHDLRKLL-DK  DFLDNSKNEKILEDIVLTLTLFEDREMIR  634
WP_019803776  561  DKLMDFLEKE--FDEFRIVDLTGLDKEnkAFNASYGTYHDLRKLL-DK  DFLDNSKNEKILEDIVLTLTLFEDREMIR  634
WP_019805234  561  DKLMDFLEKE--FDEFRIVDLTGLDKEnkAFNASYGTYHDLRKLL-DK  DFLDNSKNEKILEDIVLTLTLFEDREMIR  634
WP_024783594  561  KKLRTFLDKN--FDEFRIVDIQGLDKEteTFNASYATYQDLLKVIKDK  VFMDNPENAEILENIVLTLTLFEDREMIK  635
WP_024784288  561  DKLMDFLEKE--FDEFRIVDLTGLDKEnkVFNASYGTYHDLCKLL-DK  DFLDNSKNEKILEDIVLTLTLFEDREMIR  634
WP_024784666  561  DKLMDFLEKE--FDEFRIVDLTGLDKEnkAFNASYGTYHDLRKLL-DK  DFLDNSKNEKILEDIVLTLTLFEDREMIR  634
```

```
                     -continued
WP_024784894  561  DKLMDFLEKE--FDEFRIVDLTGLDKEnkVFNASYGTYHDLCKLL-DK  DFLDNSKNEKILEDIVLTLTLFEDREMIR  634
WP_024786433  561  KKLRTFLDKN--FDEFRIVDIQGLDKEteTFNASYATYQDLLKVIKD   VFMDNPENAEILENIVLTLTLFEDREMIK  635
WP_049473442  561  DKLMDFLEKE--FDEFRIVDLTGLDKEnkVFNASYGTYHDLCKLL-DK  DFLDNSKNEKILEDIVLTLTLFEDREMIR  634
WP_049474547  561  DKLMDFLEKE--FDEFRIVDLTGLDKEnkVFNASYGTYHDLCKLL-DK  DFLDNSKNEKILEDIVLTLTLFEDREMIR  634
EMC03581      554  DKLMDFLEKE--FDEFRIVDLTGLDKEnkAFNASYGTYHDLRKLL-DK  DFLDNSKNEKILEDIVLTLTLFEDREMIR  627
WP_000428612  565  KDIIQYLHT---VDGYDGIELKGIEKQ----FNASLSTYHDLLKIIKDK EFMDDPNNEEILENIVHTLTLFEDREMIK  635
WP_000428613  563  KDIIQFLHN---VDGYDGIELKGIEKQ----FNASLSTYHDLLKIIKDK EFMDDSKNEEILENIVHTLTLFEDREMIK  633
WP_049523028  562  KDIIHYLHN---VDGYDGIELKGIEKH----FNSSLSTYHDLLKIIKDK EFMDDPKNEEILENIVHTLTIFEDRVMIK  632
WP_003107102  531  KQLKENYFNK--IRCLDSITISGVEDK----FNASLGTYHDLLNIIKNQ KILDDEQNQDSLEDIVLTLTLFEDEKMIA  602
WP_054279288  564  KQLKEDFFSK--IECFDTVDISGVEDK----FNASLGTYHDLLKIIKDK AFLDNSENENIIEDIILTLTLFEDKEMIA  635
WP_049531101  563  KDLIHYLHN---VDGYDGIELKGIEKQ----FNANLSTYHDLLKITKDK RFMDEPKNQEILENIVHTLTIFEDREMIK  633
WP_049538452  563  KDIIQYLHN---VDGYDGIELKGIEKQ----FNASLGTYHDLLKIIKDK EFMDNPKNGEILENIIHTLTIFEDREMIK  633
WP_049549711  563  KDIIHYLHT---VDGYDGIELKGIEKQ----FNASLGTYNDLLKIIKDK EFMDDSKNEAILENIVHTLTIFEDREMIK  633
WP_007896501  565  KDLKEKYFSQ--IEGLENVDTGVEGA-----FNASLGTYNDLLKIIKDK AFLDDEANAEILEEIVLJIITLFQDEKLIE  636
EFR44625      517  KDLKEKYFSQ--IEGLENVDTGVEGA-----FNANLSTYTHDLLKITKDK EMMDDPKNEEILENIVHTLTIFEDREMIK  588
WP_002897477  562  KDIIHYLHN---VDGYDGIELKGIEKQ----FNANLSTYTHDLLKITKDK EMMDDPKNEEILENIVHTLTIFEDREMIK  632
WP_002906454  563  KDIIHYLHN---VDGYDGIELKGIEKQ----FNASLSTYHDLLKIIKDK EFMDNPKNGEILENIIHTLTIFEDREMIK  632
WP_009729476  562  KDIIQFLHN---VDGYDGIELKGIEKQ----FNASLSTYHDLLKIIKDK AFMDDAKNEAILENIVHTLTIFEDREMIK  633
CQR24647      647  KKILNELDKN--FDEFRITDIQGLDNEtgNENASYGTYHDLLKIIGDK   EFMDSSDNVDVLEDIVLSLTLFEDREMIK  636
WP_000066813  565  KDIIHYLHN---VDGYDGIELKGIEKQ----FNASLSTYHDLLKIIKDK AFMDDSKNEEILENIIHTLTIFEDREMIK  635
WP_009754323  562  KDIIHYLHN---VDGYDGIELKGIEKQ----FNASLGTYHDLLKIIKDK EFMDNHKNQEILENIVHTLTIFEDREMIK  633
WP_044674937  562  KDIKAYL-EN--SNGYAGVELKGLEEQ----FNASLPTYHDLLKILRDK AFIDAEENQEILEDIVLTLTLFEDREMIR  632
WP_044676715  561  EKLMDFLGKE--FDEFRIVDLLGLDKDnkSFNASLGTYHDLLKKIV-SK DLLDNPENEDILENVVLTLTLFEDREMIK  634
WP_044680361  562  EKLMDFLGKE--FDEFRIVDLLGLDDnkSFNASLGTYHDLLKKIV-SK  DLLDNPENEDILENVVLTLTLFEDREMIK  634
WP_044681799  562  KDIKAYL-EN--SNGYAGVELKGLEEQ----FNASLPTYHDLLKILRDK AFIDAEENQEILEDIVLTLTLFEDREMIK  632
WP_049533112  561  DKLLNYLGKE--FDEFRIVDLTGLDKEnkVENSSLGTYHDLLKIIKDK  SFLDNKENEQIIEDIIQTLTLFEDREMIK  634
WP_029090905  541  TSLKKWLAEH--EHMTVSVVQGTQKEt-EFATSLQAEHREVKIF-DR   ETVSNPANEEMFEKIIYwSTVFEDKKIMR  612
WP_050506696  562  KKLKNWLVNNqcCS--KDAEIKGFQKEN-QESTSLTPWIDETNIFGKI  ---DQSNFPDLIENIIYDLTVFEDKKIMK  637
AIT42264      568  KQLKEDYFKK--IECEDSVEISGVEDR----FNASLGTYHDLLKIIKDK DFLDNEENEDILEDIVLTLTLFEDRKMIE  633
WP_034440723  568  NQLVKYIENK--EQIIAPEIKGIEDS-----ENSNYSTYIDLSKIPDMK --LLEKEDEILEEIIKILTIFEDRKMRK  637
AKQ21048      562  KQLKEDYFKK--IECEDSVEISGVEDR----FNASLGTYHDLLKIIKDK DFLDNEENEDILEDIVLTLTLFEDREMIE  633
WP_002636532  563  KDIANYLEQ---YGVVDGTDIKGVEDK----FNASLGTYNDLAKIDGAK AYLDDPEYADVWEDIIKILTIFEDKAMRK  633
WP_002364836  570  KDIIQFYRNE--YN-TEIVTLSGLEED----QFNASFSTYQDLLKCGLTR AELDHPDNAEKLEDIIKILTIFEDRQRIR  641
WP_016631044  521  KDIIQFYRNE--YN-TEIVTLSGLEED----QFNASFSTYQDLLKCGLTR AELDHPDNAEKLEDIIKILTIFEDRQRIR  592
EMS75795      306  KKLQQFLSAN--YN-IEDAEILGVDKA----FNSSYATYHDFLDLAKPN ELLEQPEMNAMFEDIVKLTLFEDRQRIR  381
WP_002373311  570  KDIIQFYRNE--YN-TEIVTLSGLEED----QFNASFSTYQDLLKCGLTR AELDHPDNAEKLEDIIKILTIFEDRQRIR  641
WP_002378009  570  KDIIQFYRNE--YN-TEIVTLSGLEED----QFNASFSTYQDLLKCGLTR AELDHPDNAEKLEDIIKILTIFEDRQRIR  641
WP_002407324  570  KDIIQFYRNE--YN-TEIVTLSGLEED----QFNASFSTYQDLLKCGLTR AELDHPDNAEKLEDIIKILTIFEDRQRIR  641
WP_002413717  572  KDIIQFYRNE--YN-TEIVTLSGLEED----QFNASFSTYQDLLKCGLTR AELDHPDNAEKLEDIIKILTIFEDRQRIR  643
WP_010775580  570  KDIIQFYRNE--YN-TEIVTLSGLEED----QFNASFSTYQDLLKCGLTR AELDHPDNAEKLEDIIKILTIFEDRQRIR  641
WP_010818269  570  KDIIQFYRNE--YN-TEIVTLSGLEED----QFNASFSTYQDLLKCGLTR AELDHPDNAEKLEDIIKILTIFEDRQRIR  641
WP_010824395  570  KDIIQFYRNE--YN-TEIVTLSGLEED----QFNASFSTYQDLLKCGLTR AELDHPDNAEKLEDIIKILTIFEDRQRIR  641
WP_016622645  570  KDIIQFYRNE--YN-TEIVTLSGLEED----QFNASFSTYQDLLKCGLTR AELDHPDNAEKLEDIIKILTIFEDRQRIR  641
WP_033624816  570  KDIIQFYRNE--YN-TEIVTLSGLEED----QFNASFSTYQDLLKCGLTR AELDHPDNAEKLEDIIKILTIFEDRQRIR  641
WP_033625576  570  KDIIQFYRNE--YN-TEIVTLSGLEED----QFNASFSTYQDLLKCGLTR AELDHPDNAEKLEDIIKILTIFEDRQRIR  641
WP_033789179  570  KDIIQFYRNE--YN-TEIVTLSGLEED----QFNASFSTYQDLLKCGLTR AELDHPDNAEKLEDIIKILTIFEDRQRIR  641
WP_002310644  567  KDLQEFLYLK--YD-IKHAELSGIEKA----FNASYTTYHDFLTMSENK QWLEDPELASMFEEIIKTLTVFEDREMIK  641
WP_002312694  568  KDLQEFLYLK--YD-IKHAELSGIEKA----FNASYTTYHDFLTMSENK QWLEDPELASMFEEIIKTLTVFEDREMIK  642
WP_002314015  568  KDLQEFLYLK--YD-IKHAELSGIEKA----FNASYTTYHDFLTMSENK QWLEDPELASMFEEIIKTLTVFEDREMIK  642
WP_002320716  568  KDLQEFLYLK--YD-IKHAELSGIEKA----FNASYTTYHDFLTMSENK QWLEDPELASMFEEIIKTLTVFEDREMIK  642
WP_002330729  567  KDLQEFLYLK--YD-IKHAELSGIEKA----FNASYTTYHDFLTMSENK QWLEDPELASMFEEIIKTLTVFEDREMIK  641
WP_002335161  568  KDLQEFLYLK--YD-IKHAELSGIEKA----FNASYTTYHDFLTMSENK QWLEDPELASMFEEIIKTLTVFEDREMIK  642
WP_002345439  568  KDLQEFLYLK--YD-IKHAELSGIEKA----FNASYTTYHDFLTMSENK QWLEDPELASMFEEIIKTLTVFEDREMIK  642
WP_034867970  562  KKLQNFLYTH--YH-IENAQIFGIEKA----FNASYSTYHDFMKLAKTN EWLEQPEMEPIFEDIVKLTLTVFEDRQMIK  637
```

```
                                                       -continued
WP_047937432   568  KDLQEFLYLK--YD-IKHAELSGIEKA---FNASYTTYHDFLTMSENK  QWLEDPELASMFEEIIKLTVFEDREMIK   642
WP_010720994   562  KKLQNFLYTH--YH-IENAQIFGIEKA---FNASYSTYHDFMKLAKTN  EWLEQPEMEPIFEDIVKILTIFEDRQMIK  637
WP_010737004   562  KKLQNFLYTH--YH-IENAQIFGIEKA---FNASYSTYHDFMKLAKTN  EWLEQPEMEPIFEDIVKLLTIFEDRQMIK  637
WP_034700478   562  KKLQNFLYTH--YH-IENAQIFGIEKA---FNASYSTYHDFMKLAKTN  EWLEQPEMEPIFEDIVKLLTIFEDRQMIK  637
WP_007209003   564  KKLENYLRIE1---SISSPVKGIEEQ----FNANFGTYLDLKKPFDLH  PYLDDEKYQDTLEEVIKVLTVFEDRSMIQ  634
WP_023351917   560  KKLRKFLELN--EQ-IDSTEIKGIETS---FNASYSTYHDLLKLS---  TLLDDPDMTMFBEIIKILTIFEDREMIR   631
WP_010770040   564  KLLEKFLSNE--FG-LVDVAIKGIE-T---SFNAGYGTYHDFLKIGITR EQLDKEENSETLEEIVKLLTVFEDRKMIR  634
WP_048604708   560  KDLSNFLRNE--YN-LDDVIDGIE-N---KFNASPNTYHDFLKLKIDP  KVLDDPANEPMFEIVKILTIFEDRKMLR   630
WP_010750235   561  KKLQHFLSAN--YN-IEDAEILGVDKV---FNSSYATYHDFLELAKPY  ELLEQPEMEMEFEDIVKLITIFEDREMVR  636
AII16583       601  KQLKEDYFKK--IECFDSVEISGVEDR-FNASLGTYHDLLKIIKDK    DFLDNEENEDILEDIVLTLTLFEDREMIE  672
WP_029073316   576  NAMKKWLVKNqyFSNTDDIKIEGFQKEN-ACSTSLTPWIDFTKIFGEI   ----NNSNYELIEKIIYDVTVFEDKKILR  647
WP_031589969   576  NAMKKWLVKNqyFSNTDDIKIEGFQKEN-ACSTSLTPWIDFTKIFGKI   ----NESNYDFIEKIIYDVTVFEDKKILR  647
KDA45870       558  KMVIKHLKVV--MPAIRIQALKGLDNGK-FNASYGTYKDLVDMGVAP    ELLNDEVNSEKWEDIIKTLTIFEGRKLLIK 630
WP_039099354   579  KNIQDYLVSEK-RYASRPAITGLSDEnk-FNSRLSTYHDLKTIVGDA    -VDDVKQADLEKCIEWSTIFEDGKIYS    650
AKP02966       561  KKLTKWLIAQg---YYKNPILIGLSQKKd-EFNSTLTTYLDMKKIFGSS   -FMENNKNYNQIEELIEWLTIFEDKQILN  632
WP_010991369   567  KDLELFLRNM--SH-VESPTIEGLE-D---SFNSSYSTYHDLLKVGIKQ  EILDNPVNTEMLENIVKILTIFEDKRMIK  637
WP_033838504   567  KDLELFLRNM--SH-VESPTIEGLE-D---SFNSSYSTYHDLLKVGIKQ  EILDNPVNTEMLENIVKILTIFEDKRMIK  637
EHN60060       570  KDLELFLRNM--SH-VESPTIEGLE-D---SFNSSYSTYHDLLKVGIKQ  EILDNPVNTEMLENIVKILTVFEDKRMIK  640
EFR89594       336  KDLERFLYTI--SH-VESPTIEGVE-D---AFNSSFATYHDLQKGGVTQ  EILDNPLNADMLEEIVKILTLFEDKPMIK  406
WP_038409211   567  KDLERFLYTI--NH-IESPTIEGVE-D---AFNSSFATYHDLQKGGVTQ  EILDNPLNADMLEEIVKILTVFEDKRMIK  637
EFR95520       186  KDLERFLYTI--NH-IESPTIEGLE-D---AFNSSFATYHDLLKVGMKQ  EILDNPLNTEMLEDIVKILTVFEDKPMIK  256
WP_003723650   567  KDLELFLRNI--NH-IESPTIEGLE-D---SFNASYATYHDLLKVGMKQ  EILDNPLNTEMLEDIVKILTVFEDKPMIK  637
WP_003727705   567  KDLELFLRNI--NH-IESPTIEGLE-D---SFNASYATYHDLLKVGIKQ  EILDNPLNTEILEDIVKILTVFEDKRMIK  637
WP_003730785   567  KDLELFLRNI--NH-IESPTIEGLE-D---SFNASYATYHDLLKVGIKQ  EILDNPLNTEMLEDIVKILTVFEDKRMIK  637
WP_003733029   567  KDLELFLRNI--NQ-IESPTIEGLE-D---SFNASYATYHDLLKVGIKQ  EILDNPLNTEMLEDIVKILTVFEDKRMIK  637
WP_003739838   567  KDLEQPLRNM--SH-IESPTIEGLE-D---SFNSSYATYHDLLKVGIKQ  EVLENPLNTEMLEDIVKILTVFEDKRMIK  637
WP_014601172   567  KDLELFLRNI--NH-IESPTIEGLE-D---SFNASYATYHDLLKVGMKQ  EILDNPLNTEMLEDIVKILTVFEDKRMIK  637
WP_023548323   567  KDLELFLRNI--NH-IESPTIEGLE-D---SFNASYATYHDLLKVGIKQ  EILDNPLNTEMLEDIVKILTVFEDKRMIK  637
WP_031665337   567  KDLELFLRNI--NQ-IESPTIEGLE-D---SFNASYATYHDLLMKVGIKQ EILDNPLNTEMLEDIVKILTVFEDKRMIK  637
WP_031669209   567  KDLELFLRNI--NQ-IESPTIEGLE-D---SFNASYATYHDLLKVGMKQ  EILDNPLNTEMLEDIVKILTVFEDKRMIK  637
WP_033920898   570  KDLELFLRNI--NH-VESPTIEGLE-D---SFNASYATYHDLLKVGMKQ  EILDNPLNTEMLEDIVKILTVFEDKPMIK  640
AKI42028       570  KDLELFLRNI--NH-IESPTIEGLE-D---SFNASYATYHDLMKVGIKQ  EILDNPLNTEMLEDIVKILTVFEDKPMIK  640
AKI50529        15  KDLELFLYNM--NH-VESPTVEGVE-D---AFNSFFTTYHDLQKVGVPQ  EILDDPLNTEMLEEIIKILTVFEDKRMIN   85
EFR83390       567  KDLELFLYNM--NH-VESPTVEGVE-D---AFNSFFTTYHDLQKVGVPQ  EILDDPLNTEMLEEIIKILTVFEDKRMIN  637
WP_046323366   578  KQLKEDYFKK--IECFDSVEISGVEDR-FNASGTYHDLLKIIKDK     DFLDNEENEDILEDIVLTLTLFEDREMIE  649
AKE81011       572  KKLKNWLVNNgcCR--KDAEIKGFQKEn-QFSTSLAPWIDFTNIFGKI    ----DQSNFDLIEKIIYDLTVFEDKKIMK  641
CUO82355       573  KKLKDWLVTHqyYDINEELKIEGYQKD1-QFSTSLAPWIDFTKIFGEI    ----NASNYQLIEKIIYDISIFEDKKILK  644
WP_033162887   595  KQLKEDYFKK--IECFDSVEISGVEDR-FNASLGTYHDLLKIIKDK     DFLDNEENEDILEDIVLTLTLFEDREMIE  666
AGZ01981       562  KQLKEDYFKK--IECFDSVEISGVEDR-FNASLGTYHDLLKIIKDK     DFLDNEENEDILEDIVLTLTLFEDREMIE  633
AKA60242       566  KQLKEDYFKK--IECFDSVEISGVEDR-FNASLGTYHDLLKIIKDK     DFLDNEENEDILEDIVLTLTLFEDREMIE  637
AKS40380       634                                                                                   637
4UN5_B         638  ERLKTYAHLFDDKVMKQLKR-RRYTGWGRLSRKLINGIRDK    QSGKTILDFLK  ENNKTILDYLI   -DGf---ANRNFMQLIHDDSL  706
WP_010922251   633  ERLQKYSDIPTANQLKKLER-RHYTGWGRLSYKLINGIRNK    QSGKTILDFLK  QTGNTILDYLI   DDG----SANRNFMQLINDDTL 702
WP_039695303   369  QRLAQYDSLFDEKVIKALTR-RHYTGWGKLSAKLINGICDK    ---------    ---LW         DDG----KINRNFMQLINDDGL 701
WP_045635197   318  EELTNLNSELTQEEIEQISNlKGYTGTHNLSLKAINLILDE             QSGKTILDFLK  TNDNQIAIFNRLKL -DGf---ANRNFMQLIHDDSL  426
5AXW_A         634  ERLKTYAHLFDDKVMKQLKR-RRYTGWGRLSRKLINGIRDK    QSGKTILDFLK   -------Lw    -DGf---ANRNFMQLIHDDSL  702
WP_009880683   634  ERLKTYAHLFDDKVMKQLKR-RRYTGWGRLSRKLINGIRDK    QSGKTILDFLK               -DGf---ANRNFMQLIHDDSL  702
WP_010922251   634  ERLKTYAHLFDDKVMKQLKR-RRYTGWGRLSRKLINGIRDK    QSGKTILDFLK               -DGf---ANRNFMQLIHDDSL  702
WP_011054416   634  ERLKTYAHLFDDKVMKQLKR-RRYTGWGRLSRKLINGIRDK    QSGKTILDFLK               -DGf---ANRNFMQLIHDDSL  702
WP_011284745   634  ERLKTYAHLFDDKVMKQLKR-RRYTGWGRLSRKLINGIRDK    QSGKTILDFLK               -DGf---ANRNFMQLIHDDSL  702
WP_011285506   633  ERLKTYAHLFDDKVMKQLKR-RRYTGWGRLSRKLINGIRDK    QSGKTILDFLK               -DGf---ANRNFMQLIHDDSL  702
WP_011527619   634  ERLKTYAHLFDDKVMKQLKR-RRYTVWGRLSRKLINGIRDK    QSGKTILDFLK               -DGf---ANRNFMQLIHDDSL  702
```

```
                                                         -continued
WP_012560673  634  ERLKTYAHLFDDKVMKQLKR-RRYTGWGRLSRKLINGIRDK  QSGKTILDFLK  -DGF---ANRNFMQLIHDDSL  702
WP_014407541  634  ERLKTYAHLFDDKVMKQLKR-RRYTGWGRLSRKLINGIRDK  QSGKTILDFLK  -DGF---ANRNFMQLIHDDSL  702
WP_020905136  634  ERLKTYAHLFDDKVMKQLKR-RRYTGWGRLSRKLINGIRDK  QSGKTILDFLK  -DGF---ANRNFMQLIHDDSL  702
WP_023080005  634  ERLKKYANLFDDKVMKQLKR-RHYTGWGRLSRKLINGIRDK  QSGKTILDFLK  -DGF---ANRNFMQLIHDDSL  702
WP_023610282  634  ERLKKYANLFDDKVMKQLKR-RRYTGWGRLSRKLINGIRDK  QSGKTILDFLK  -DGF---ANRNFMQLIHDDSL  702
WP_030125963  634  ERLKTYAHLFDDKVMKQLKR-RRYTGWGRLSRKLINGIRDK  QSGKTILDFLK  -DGF---ANRNFMQLIHDDSL  702
WP_030126706  634  ERLKTYAHLFDDKVMKQLKR-RRYTGWGRLSRKLINGIRDK  QSGKTILDFLK  -DGF---ANRNFMQLIHDDSL  702
WP_031488318  634  ERLKTYAHLFDDKVMKQLKR-RRYTGWGRLSRKLINGIRDK  QSGKTILDFLK  -DGF---ANRNFMQLIHDDSL  702
WP_032460140  634  ERLKTYAHLFDDKVMKQLKR-RRYTGWGRLSRKLINGIRDK  QSGKTILDFLK  -DGF---ANRNFMQLIHDDSL  702
WP_032461047  634  ERLKTYAHLFDDKVMKQLKR-RRYTGWGRLSRKLINGIRDK  QSGKTILDFLK  -DGF---ANRNFMQLIHDDSL  702
WP_032462016  634  ERLKTYAHLFDDKVMKQLKR-RRYTGWGRLSRKLINGIRDK  QSGKTILDFLK  -DGF---ANRNFMQLIHDDSL  702
WP_032462936  634  ERLKTYAHLFDDKVMKQLKR-RRYTGWGRLSRKLINGIRDK  QSGKTILDFLK  -DGF---ANRNFMQLIHDDSL  702
WP_032464890  634  ERLKKYANLFDDKVMKQLKR-RRYTGWGRLSRKLINGIRDK  QSGKTILDFLK  -DGF---ANRNFMQLIHDDSL  702
WP_033888930  459  ERLKTYAHLFDDKVMKQLKR-RRYTGWGRLSRKLINGIRDK  QSGKTILDFLK  -DGF---ANRNFMQLIHDDSL  527
WP_038431314  634  ERLKKYANLFDDKVMKQLKR-RHYTGWGRLSRKLINGIRDK  QSGKTILDFLK  -DGF---ANRNFMQLIHDDSL  702
WP_038432938  634  ERLKKYANLFDDKVMKQLKR-RRYTGWGRLSRKLINGIRDK  QSGKTILDFLK  -DGF---ANRNFMQLIHDDSL  702
WP_038434062  634  ERLKTYAHLFDDKVMKQLKR-RRYTGWGRLSRKLINGIRDK  QSGKTILDFLK  -DGF---ANRNFMQLIHDDSL  702
BAQ51233      545  ERLKTYAHLFDDKVMKQLKR-RRYTGWGRLSRKLINGIRDK  QSGKTILDFLK  -DGF---ANRNFMQLIHDDSL  613
KGE60856      ---  --------------------------------------  -----------  --------------------  ---
KGE60162      634  ERLKTYAHLFDDKVMKQLKR-RRYTGWGRLSRKLINGIRDK  QSGKTILDFLK  -DGF---ANRNFMQLIHDDSL  702
WP_002989955  635  QRLQKYSDIFTKAQLKKLER-RHYTGWGRLSYKLINGIRNK  ENKKTILDYLI  DDG---YANRNFMQLINDDAL  703
WP_003030002  638  ERLQKYSDIFTADQLKKLER-RHYTGWGRLSYKLINGIRNK  ENNKTILDYLI  DDG---SANRNFMQLINDDTL  706
WP_003065552  636  KRLDIYKDLFTESQLKKLYR-RHYTGWGRLSAKLINGIRDK  ENQKTILDYLI  DDG---SANRNFMQLINDDGL  704
WP_001040076  636  KRLDIYKDLFTESQLKKLYR-RHYTGWGRLSAKLINGIRDK  ESQKTILDYLI  DDG---RSNRNFMQLINDDGL  704
WP_001040080  636  KRLENYKDLFTESQLKKLYR-RHYTGWGRLSAKLINGIRDK  ESQKTILDYLI  DDG---RSNRNFMQLINDDGL  704
WP_001040081  636  KRLENYKDLFTESQLKKLYR-RHYTGWGRLSAKLINGIRDK  ENQKTILDYLI  DDG---RSNRNFMQLINDDGL  704
WP_001040083  636  KRLENYKDLFTESQLKKLYR-RHYTGWGRLSAKLINGIRDK  ENQKTILDYLI  DDG---RSNRNFMQLINDDGL  704
WP_001040085  636  KRLENYKDLFTESQLKKLYR-RHYTGWGRLSAKLINGIRDK  ENQKTILDYLI  DDG---RSNRNFMQLINDDGL  704
WP_001040087  636  KRLENYKDLFTESQLKKLYR-RHYTGWGRLSAKLINGIRDR  ESQKTILDYLI  SDG---RANRNFMQLIKDAGL  704
WP_001040088  636  KRLENYKDLFTESQLKKLYR-RHYTGWGRLSAKLINGIRNK  ENQKTILDYLI  DDG---RSNRNFMQLINDDGL  704
WP_001040089  633  KRLDIYKDFFTESQLKKLYR-RHYTGWGRLSAKLINGIRNK  ESQKTILDYLI  DDG---SANRNFMQLIKDAGL  701
WP_001040090  636  KRLENYKDLFTESQLKKLYR-RHYTGWGRLSAKLINGIRDK  ENQKTILDYLI  DDG---SANRNFMQLINDDGL  704
WP_001040091  636  KRLENYKDLFTESQLKKLYR-RHYTGWGRLSAKLINGIRDK  ENQKTILDYLI  DDG---SANRNFMQLINDDGL  704
WP_001040092  636  KRLENYKDLFTESQLKKLYR-RHYTGWGRLSAKLINGIRDR  ESQKTILDYLI  SDG---SANRNFMQLIKDAGL  704
WP_001040094  633  KRLDIYKDFFTESQLKKLYR-RHYTGWGRLSAKLINGIRNK  ESQKTILDYLI  DDG---SANRNFMQLIKDAGL  701
WP_001040095  633  KRLDIYKDFFTESQLKKLYR-RHYTGWGRLSAKLINGIRNK  ESQKTILDYLI  DDG---RSNRNFMQLINDDGL  701
WP_001040096  636  KRLENYKDLFTESQLKKLYR-RHYTGWGRLSAKLINGIRDK  ENQKTILDYLI  DDG---SANRNFMQLINDDGL  704
WP_001040097  636  KRLENYKDLFTESQLKKLYR-RHYTGWGRLSAKLINGIRDK  ENQKTILDYLI  DDG---SANRNFMQLIKDAGL  704
WP_001040098  633  KRLDIYKDFFTESQLKKLYR-RHYTGWGRLSAKLINGIRNK  ENQKTILDYLI  DDG---SANRNFMQLIKDAGL  701
WP_001040099  633  KRLDIYKDFFTESQLKKLYR-RHYTGWGRLSAKLINGIRNK  ENQKTILDYLI  DDG---SANRNFMQLIKDAGL  701
WP_001040100  633  KRLDIYKDFFTESQLKKLYR-RHYTGWGRLSAKLINGIRNK  ENQKTILDYLI  DDG---SANRNFMQLIKDAGL  701
WP_001040104  636  KRLENYKDLFTESQLKKLYR-RHYTGWGRLSAKLINGIRDK  ESQKTILDYLI  DDG---RSNRNFMQLIKDAGL  704
WP_001040105  636  KRLENYKDLFTESQLKKLYR-RHYTGWGRLSAKLINGIRDK  ENQKTILDYLI  DDG---RANRNFMQLIHDDGL  704
WP_001040106  636  KRLENYKDLFTESQLKKLYR-RHYTGWGRLSAKLINGIRDK  ESQKTILDYLI  DDG---RANRNFMQLIHDDGL  704
WP_001040107  636  KRLENYKDLFTESQLKKLYR-RHYTGWGRLSAKLINGIRDK  ESQKTILDYLI  DDG---RANRNFMQLIHDDGL  704
WP_001040108  636  KRLENYKDLFTESQLKKLYR-RHYTGWGRLSAKLINGIRDK  ESQKTILDYLI  SDG---RANRNFMQLIHDDGL  704
WP_001040109  636  KRLENYKDLFTESQLKKLYR-RHYTGWGRLSAKLINGIRDK  ESQKTILDYLI  SDG---RANRNFMQLIHDDGL  704
WP_001040110  636  KRLENYKDLFTESQLKKLYR-RHYTGWGRLSAKLINGIRDK  ESQKTILDYLI  SDG---RANRNFMQLIHDDGL  704
WP_015058523  633  KRLDIYKDFFTESQLKKLYR-RHYTGWGRLSAKLINGIRDR  ENQKTILDYLI  DDG---RANRNFMQLIHDDGL  701
WP_017643650  636  KRLENYKDLFTESQLKKLYR-RHYTGWGRLSAKLINGIRDK  ESQKTILDYLI  DDG---SANRNFMQLIHDDGL  704
WP_017647151  636  KRLENYKDLFTESQLKKLYR-RHYTGWGRLSAKLINGIRDR  ESQKTILDYLI  DDG---KSNRNFMQLINDDGL  704
WP_017648376  636  KRLENYKDLFTESQLKKLYR-RHYTGWGRLSAKLINGIRDK  ESQKTILDYLI  DDG---RSNRNFMQLINDDGL  704
WP_017649527  636  KRLENYKDLFTESQLKKLYR-RHYTGWGRLSAKLINGIRDK  ESQKTILDYLI  DDG---RSNRNFMQLINDDGL  704
```

| | | | | |
|---|---|---|---|---|
| WP_017771611 | 636 | KRLENYKDLFTESQLKKLYR-RHYTGWGRLSAKLINGIRDK ESQKTILDYLI | SDG---RANRNFMQLIHDDGL | 704 |
| WP_017771984 | 636 | KRLENYKDLFTESQLKKLYR-RHYTGWGRLSAKLINGIRDK ESQKTILDYLI | DDG---RSNRNFMQLINDDGL | 704 |
| CFQ25032 | 636 | KRLENYKDLFTESQLKKLYR-RHYTGWGRLSAKLINGIRDK ESQKTILDYLI | DDG---RSNRNFMQLINDDGL | 704 |
| CFV16040 | 636 | KRLENYKDLFTESQLKKLYR-RHYTGWGRLSAKLINGIRDK ESQKTILDYLI | DDG---RSNRNFMQLINDDGL | 704 |
| KLJ37842 | 636 | KRLENYKDLFTESQLKKLYR-RHYTGWGRLSAKLINGIRDK ESQKTILDYLI | DDG---RSNRNFMQLINDDGL | 704 |
| KLJ72361 | 636 | KRLENYKDLFTESQLKKLYR-RHYTGWGRLSAKLINGIRDK ESQKTILDYLI | DDG---RSNRNFMQLINDDGL | 704 |
| KLL20707 | 636 | KRLENYKDLFTESQLKKLYR-RHYTGWGRLSAKLINGIRDK ESQKTILDYLI | SDG---RANRNFMQLIHDDGL | 718 |
| KLL42645 | 636 | KRLENYKDLFTESQLKKLYR-RHYTGWGRLSAKLINGIRDK ESQKTILDYLI | DDG---RSNRNFMQLIHDDGL | 704 |
| WP_047207273 | 636 | KRLDIYKDFFTESQLKKLYR-RHYTGWGRLSAKLINGIRDK ESQKTILDYLI | DDG---SANRNFMQLIKDAGL | 701 |
| WP_047209694 | 633 | KRLENYKDLFTESQLKKLYR-RHYTGWGRLSAKLINGIRNK ENQKTILDYLI | DDG---SANRNFMQLIKDAGL | 704 |
| WP_050198062 | 636 | KRLENYKDLFTESQLKKLYR-RHYTGWGRLSAKLINGIRDK ESQKTILDYLI | DDG---RSNRNFMQLINDDAL | 704 |
| WP_050201642 | 636 | KRLENYKDLFTESQLKKLYR-RHYTGWGRLSAKLINGIRDK ESQKTILDYLI | DDG---RSNRNFMQLINDDGL | 704 |
| WP_050204027 | 636 | KRLENYKDLFTESQLKKLYR-RHYTGWGRLSAKLINGIRDK ESQKTILDYLI | SDG---RANRNFMQLIHDDGL | 704 |
| WP_050881965 | 636 | KRLENYKDLFTESQLKKLYR-RHYTGWGRLSAKLINGIRDK ESQKTILDYLI | DDG---RSNRNFMQLIHDDGL | 704 |
| WP_050886065 | 636 | KRLENYKDLFTESQLKKLYR-RHYTGWGRLSAKLINGIRDK ESQKTILDYLI | DDG---RANRNFMQLIHDDGL | 704 |
| AHN30376 | 636 | KRLENYKDLFTESQLKKLYR-RHYTGWGRLSAKLINGIRDR ESQKTILDYLI | SDG---RSNRNFMQLINDDGL | 704 |
| EAO78426 | 636 | KRLENYKDLFTESQLKKLYR-RHYTGWGRLSAKLINGIRDK ENQKTILDYLI | DDG---RSNRNFMQLINDDGL | 704 |
| CCW42055 | 636 | KRLDIYKDFFTESQLKKLYR-RHYTGWGRLSAKLINGIRNK ENKKTILDYLI | DDG---YANRNFMQLINDDAL | 703 |
| WP_003041502 | 635 | QRLQKYSDIFTKAQLKKLER-RHYTGWGKLSYKLINGIRNK ENKKTILDYLI | DDG---YANRNFMQLINDDAL | 704 |
| WP_037593752 | 636 | QRLQKYSDIFTKAQLKKLER-RHYTGWGKLSYKLINGIRNK ENKKTILDYLI | DDG---YANRNFMQLINDDAL | 704 |
| WP_049516684 | 635 | QRLQKYSDIPTTQQLKKLER-RHYTGWGRLSYKLINGIRNK ENKKTILDYLI | DDG---YANRNFMQLINDDAL | 703 |
| GAD46167 | 635 | QRLQKYSDIFTKAQLKKLER-RHYTGWGRLSYKLINGIRNK ENKKTILDYLI | DDG---SANRNFMQLINDDAL | 703 |
| WP_018363470 | 644 | ERLKTYAHLFDDKVMKQLKR-RHYTGWGRLSRKMINGIRDK ENKKTILDFLK | -Dgf---YANRNFIQLIHDDSL | 712 |
| WP_003043819 | 635 | QRLQKYSDIFTKAQLKKLER-RHYTGWGRLSYKLINGIRNK ENKKTILDFLK | DDG---YANRNFMQLINDDTL | 703 |
| WP_006269658 | 635 | ERLKKYANLFDDKVMKQLKR-RHYTGWGRLSRKLINGIRDK QSGKTILDFLK | -Dgf---ANRNFIQLIHDDSL | 703 |
| WP_048800889 | 635 | QRLQKYSDIFTKAQLKKLER-RHYTGWGRLSYKLINGIRDK QSGKTILDFLK | DDG---ANRNFIQLIHDDSL | 703 |
| WP_012767106 | 634 | ERLKKYANLFDDKVMKQLKR-RHYTGWGRLSRKLINGIRDK QSGKTILDFLK | -Dgf---ANRNFIQLIHDDSL | 702 |
| WP_014612333 | 634 | ERLKKYANLFDDKVMKQLKR-RHYTGWGRLSRKLINGIRDK QSGKTILDFLK | -Dgf---ANRNFMQLIHDDSL | 702 |
| WP_015017095 | 634 | ERLKTYAHLFDDKVMKQLKR-RHYTGWGRLSRKLINGIRDK QSGKTILDFLK | -Dgf---ANRNFMQLIHDDSL | 702 |
| WP_015057649 | 634 | ERLKKYANLFDDKVMKQLKR-RHYTGWGRLSRKLINGIRDK QSGKTILDFLK | -Dgf---ANRNFMQLIHDDSL | 702 |
| WP_048272215 | 634 | ERLKKYANLFDDKVMKQLKR-RHYTGWGRLSRKLINGIRDK QSGKTILDFLK | -Dgf---ANRNFMQLIHDDSL | 702 |
| WP_049519324 | 634 | ERLKTYAHLFDDKVMKQLKR-RHYTGWGRLSRKLINGIRDK QSGKTILDFLK | -Dgf---ANRNFMQLIHDDSL | 702 |
| WP_012515931 | 634 | KRLDQYAHLFDKVVLNKLER-RHYTGWGRLSGKLINGIRDK QSGKTILDFLK | -Dgf---ANRNFMQLIHDSEL | 702 |
| WP_021320964 | 635 | KRLDQYAHLFDKVVLNKLER-RHYTGWGRLSGKLINGIRNK ENNKTILDFLI | DDG---DANRNFMQLIHDDSL | 704 |
| WP_037581760 | 635 | ERLQKYSDIFTSQQLKKLKR-RHYTGWGKLSRKLIDGIRNR ENNKTILDFLI | DDG---SANRNFMQLINDDTL | 704 |
| WP_004232481 | 636 | ERLQKYSDIFTANQLKKLER-RHYTGWGKLSAKLINGICDK ENGKSILDYLI | DDG---YANRNFMQLINDDTL | 704 |
| WP_009854540 | 638 | QRLQKYSDIFTPQQLKKLER-RHYTGWGKLSYKLINGIRNK ENNKTILDFLI | DDG---SANRNFMQLIHDDTL | 706 |
| WP_012962174 | 634 | ERLQKYSDIFTANQLKKLER-RHYTGWGKLSAKLINGIRNK ENNKTILDFLI | DDG---HANRNFMQLINDESL | 703 |
| WP_039695303 | 634 | KRLENYSDLLTKEQVKKLER-RHYTGWGRLSAELIHGIRNK QTGKTILGFLK | -DGv---ANRNFMQLINDSSL | 702 |
| WP_014334983 | 634 | RRLVKYADVFEKSVLKKLKK-RHYTGWGRLSQKLINGIKDK QTGKTILGFLK | -DGv---ANRNFMQLINDSSL | 702 |
| WP_003099269 | | RRLVKYADVFEKSVLKKLKK-RHYTGWGRLSQKLINGIKDK QTGKTILGFLK | | |
| AHY15608 | | ------ | | |
| AHY17476 | | ------ | | |
| ESR09100 | | ------ | | |
| AGM98575 | 634 | RRLVKYADVFEKSVLKKLKK-RHYTGWGRLSQKLINGIKDK QTGKTILGFLK | -DGv---ANRNFMQLINDSSL | 702 |
| ALF27331 | 635 | KRLENYSDLLTKEQVKNLER-RHYTGWGRLSAELIHGIRNK ESRKTILDYLI | DDG---NSNRNFMQLINDDAL | 703 |
| WP_018372492 | 648 | KRLSELNIPFENKIIKKLAR-KKYTGWGNLSRKLIDGIRNR ETNRTILGHLI | DDG---SNRNLMQLINDDGL | 716 |
| WP_045618028 | 634 | QRLAHYASIFDEKVIKALTR-RHYTGWGKLSAKLINGICDK QSKKTILDYLI | DDG---EINRNFMQLINDDGL | 701 |
| WP_045635197 | 633 | QRLAQYDSLFDEKVIKALTR-RHYTGWGKLSAKLINGICDK QTGNTILDYLI | DDG---KINRNFMQLINDDGL | 703 |
| WP_002263549 | 635 | KRLENYSDLLTKEQVKKLER-RHYTGWGRLSAELIHGIRNK ESRKTILDYLI | DDG---NSNRNFMQLINDSSL | 703 |
| WP_002263887 | 634 | KRLENYSDLLTKEQVKKLER-RHYTGWGRLSAELIHGIRNK ESRKTILDYLI | -DGv---NSNRNFMQLINDSSL | 702 |
| WP_002264920 | 635 | KRLKNYSDLLTKEQLKKLER-RHYTGWGRLSAELIHGIRNK ESRKTILDYLI | DDG---NSNRNFMQLINDSSL | 703 |
| WP_002269043 | 635 | KRLENYSDLLTKEQLKKLER-RHYTGWGRLSAELIHGIRNK ESRKTILDYLI | DDG---NSNRNFMQLINDDAL | 703 |
| WP_002269448 | 635 | KRLENYSDLLTKEQLKKLER-RHYTGWGRLSAELIHGIRNK ESRKTILDYLI | DDG---NSNRNFMQLINDDAL | 703 |

```
WP_002271977   635  KRLENYSDLLTKEQVKKLER-RHYTGWGRLSAELIHGIRNK  ESRKTILDYLI  DDG--NSNRNFMQLINDDAL  703
WP_002272766   635  KRLENYSDLLTKEQVKKLER-RHYTGWGRLSAELIHGIRNK  ESRKTILDYLI  DDG--NSNRNFMQLINDDAL  703
WP_002273241   635  KRLENYSDLLTKEQVKKLER-RHYTGWGRLSAELIHGIRNK  ESRKTILDYLI  DDG--NSNRNFMQLINDDAL  703
WP_002275430   635  KRLENYSDLLTKEQVKKLER-RHYTGWGRLSAELIHGIRNK  ESRKTILDYLI  DDG--NSNRNFMQLINDDAL  703
WP_002276448   635  QRLAKYADVPDKKVIDQLAR-RHYTGWGRLSAKLLNGIRDK  QSCKTIMDYLI  DDA--QSNRNLMQLITDDNL  704
WP_002277050   635  KRLENYSDLLTKEQVKKLER-RHYTGWGRLSAELIHGIRNK  ESRKTILDYLI  DDG--NSNRNFMQLINDDAL  703
WP_002277364   635  KRLKNYSDLLTKEQVKKLER-RHYTGWGRLSAELIHGIRNK  ESRKTILDYLI  DDG--NSNRNFMQLINDDAL  703
WP_002279025   635  KRLENYSDLLTKEQVKKLER-RHYTGWGRLSAELIHGIRNK  ESRKTILDYLI  DDG--NSNRNFMQLINDDAL  703
WP_002279859   635  KRLENYSDLLTKEQLKKLER-RHYTGWGRLSAELIHGIRNK  ESRKTILDYLI  DDG--NSNRNFMQLINDDAL  703
WP_002280230   635  KRLENYSDLLTKEQVKKLER-RHYTGWGRLSAELIHGIRNK  ESRKTILDYLI  DDG--NSNRNFMQLINDDAL  703
WP_002281696   635  KRLENYSDLLTKEQVKKLER-RHYTGWGRLSAELIHGIRNK  ESRKTILDYLI  DDG--NSNRNFMQLINDDAL  703
WP_002282247   636  QRLAKYADVPDKKVIDQLAR-RHYTGWGRLSAELIHGIRNK  QSCKTIMDYLI  DDA--QSNRNLMQLITDDNL  704
WP_002282906   635  KRLENYSDLLTKEQVKKLER-RHYTGWGRLSAELIHGIRNK  ESRKTILDYLI  DDG--NSNRNFMQLINDDAL  703
WP_002283846   635  KRLENYSDLLTKEQLKKLER-RHYTGWGRLSAELIHGIRNK  ESRKTILDYLI  DDG--NSNRNFMQLINDDAL  703
WP_002287255   635  KRLKNYSDLLTKEQVKKLER-RHYTGWGRLSAELIHGIRNK  ESRKTILDYLI  DDG--NSNRNFMQLINDDAL  703
WP_002288990   636  KRLKNYSDLLTKEQVKKLER-RHYTGWGRLSAELIHGIRNK  ESRKTILDYLI  DDG--NSNRNFMQLINDDAL  704
WP_002289641   635  KRLENYSDLLTKEQVKKLER-RHYTGWGRLSAELIHGIRNK  ESRKTILDYLI  DDG--NSNRNFMQLINDDAL  703
WP_002290427   635  KRLKNYSDLLTKEQLKKLER-RHYTGWGRLSAELIHGIRNK  ESRKTILDYLI  DDG--NSNRNFMQLINDDAL  703
WP_002295753   635  KRLKNYSDLLTKEQLKKLER-RHYTGWGRLSAELIHGIRNK  ESRKTILDYLI  DDG--NSNRNFMQLINDDAL  703
WP_002296423   635  KRLKNYSDLLTKEQLKKLER-RHYTGWGRLSAELIHGIRNK  ESRKTILDYLI  DDG--NSNRNFMQLINDDAL  703
WP_002304487   645  QRLQKYSDIPTKAQLKKLER-RHYTGWGRLSYKLINGIRDK  QSNKTILGYLI  DDG--YSNRNFMQLINDDAL  713
WP_002305844   635  KRLENYSDLLTKEQVKKLER-RHYTGWGRLSAELIHGIRNK  ESRKTILDYLI  DDG--NSNRNFMQLINDDAL  703
WP_002307203   635  KRLENYSDLLTKEQVKKLER-RHYTGWGRLSAELIHGIRNK  ESRKTILDYLI  DDG--NSNRNFMQLINDDAL  703
WP_002310390   635  KRLKNYSDLLTKEQLKKLER-RHYTGWGRLSAELIHGIRNK  ESRKTILDYLI  DDG--NSNRNFMQLINDDAL  703
WP_002352408   635  KRLENYSDLLTKEQVKKLER-RHYTGWGRLSAELIHGIRDK  ESRKTILDYLI  DDG--NSNRNFMQLINDDAL  703
WP_012997688   635  KRLENYSDLLTKEQVKKLER-RHYTGWGRLSAELIHGIRNK  ESRKTILDYLI  DDG--NSNRNFMQLINDDAL  703
WP_014677909   636  QRLAKYADVPDKKVIDQLAR-RHYTGWGRLSAKLLNGIRDK  QSCKTIMDYLI  DDA--QSNRNLMQLITDDNL  704
WP_019312892   635  KRLENYSDLLTKEQVKKLER-RHYTGWGRLSAELIHGIRNK  ESRKTILDYLI  DDG--NSNRNFMQLINDDAL  703
WP_019313659   635  KRLENYSDLLTKEQVKKLER-RHYTGWGRLSAELIHGIRNK  ESRKTILDYLI  DDG--NSNRNFMQLINDDAL  703
WP_019314093   635  KRLENYSDLLTKEQVKKLER-RHYTGWGRLSAELIHGIRNK  ESRKTILDYLI  DDG--NSNRNFMQLINDDAL  703
WP_019315370   635  KRLENYSDLLTKEQVKKLER-RHYTGWGRLSAELIHGIRNK  ESRKTILDYLI  DDG--NSNRNFMQLINDDAL  703
WP_019803776   635  KRLENYSDLLTKEQVKKLER-RHYTGWGRLSAELIHGIRNK  ESRKTILDYLI  DDG--NSNRNFMQLINDDAL  703
WP_019805234   635  KRLENYSDLLTKEQVKKLER-RHYTGWGRLSAELIHGIRNK  ESRKTILDYLI  DDG--NSNRNFMQLINDDAL  703
WP_024783594   635  KRLENYSDLLTKEQVKKLER-RHYTGWGRLSAELIHGIRNK  ESRKTILDYLI  DDG--NSNRNFMQLINDDAL  703
WP_024784288   636  QRLAKYADVPDKKVIDQLAR-RHYTGWGRLSAKLLNGIRDK  QSCKTIMDYLI  DDA--QSNRNLMQLITDDNL  704
WP_024784666   635  KRLENYSDLLTKEQVKKLER-RHYTGWGRLSAELIHGIRNK  ESRKTILDYLI  DDG--NSNRNFMQLINDDAL  703
WP_024784894   635  KRLENYSDLLTKEQVKKLER-RHYTGWGRLSAELIHGIRNK  ESRKTILDYLI  DDG--NSNRNFMQLINDDAL  703
WP_024786433   636  QRLAKYADVPDKKVIDQLAR-RHYTGWGRLSAKLLNGIRDK  QSCKTIMDYLI  DDA--QSNRNLMQLITDDNL  704
WP_049473442   635  KRLENYSDLLTKEQVKKLER-RHYTGWGRLSAELIHGIRNK  ESRKTILDYLI  DDG--NSNRNFMQLINDDAL  703
WP_049474547   637  KRLAKYANLFEKSVLKKLRK-RHYRGWGRLSRQLIDGMKDK  ASGKTILDFLK  DDG--YNNRNFMQLINDDGL  705
EMC03581       628  KRLAKYANLFEKSVLKKLRK-RHYRGWGRLSRQLIDGMKDK  ASGKTILDFLK  DDG--YNNRNFMQLINDDGL  696
WP_000428612   636  QRLAQYDSLFDEKVIKALTR-RHYTGWGKLSSKLINGIRDK  QTGNTILDYLM  DDG--KNNRNFMQLINDDEL  704
WP_000428613   634  QRLAQYDSLFDEKVIKALTR-RHYTGWGKLSAKLINGIRDK  QTGNTILDYLI  DDG--YSNRNFMQLINDDGL  702
WP_049523028   636  QRLNQYDSIFDEKVIKALTR-RHYTGWGKLSAKLINGIRDK  KTSKTILDYLI  -DGq--ANRNFMQLINDPSL  671
WP_003107102   603  KRLSKYESIFPDSILKKLKK-RHYTGWGRLSQKLINGIRDK  QTGKTILDFLK  -DGf--INRNFMQLINDDNL  704
WP_054279288   636  NRLAVYEDLFPDQNVLKQLKR-RHYTGWGRLSAKLINGMRDK  HTGKTILDFLK  -DGf--INRNFMQLINDDNL  704
WP_049531101   634  QRLAQYASIFDEKVIKTLTR-RHYTGWGKLSAKLINCIRDR  KTGKTILDYLI  DDG--YNNRNFMQLINDDGL  702
WP_049538452   634  QRLAQYDSLFDKKVIKALTR-RHYTGWGKLSAKLINGICDK  QTGNTILDYLI  DDG--YSNRNFMQLINDDGL  702
WP_049549711   637  KRLAKYANLFEKSVLKKLRK-RHYTGWGKLSRQLIDGMKDK  QTGNTILDYLI  -DDf--ANRNFIQLINDSSL  705
WP_007896501   589  KRLAKYANLFEKSVLKKLRK-RHYRGWGKLSRQLIDGMKDK  ASGKTILDFLK  -DDf--ANRNFIQLINDSSL  657
EFR44625       633  QRLAQYDTLFDEKVIKALTR-RHYTGWGKLSAKLINGIRDK  QSGKTILDYLI  DDD--KINRNFMQLINDDGL  701
WP_002897477   633  QRLAQYDSLFDEKVIKALTR-RHYTGWGKLSAKLINGIRDK  QTGKTILEYLI  DDG--DCNRNFMQLINDDGL  701
WP_029006454   634  QRLAQYDSLFDEKVIKALTR-RHYTGWGKLSAKLINGIRDK  QTGNTILDYLI  DDG--EINRNFMQLINDDGL  702
WP_009729476   634  QRLAQYDSLFDEKVIKALTR-RHYTGWGKLSAKLINGISDK  QTGNTILDYLI  DDG--EINRNFMQLINDDGL  702
```

```
                   -continued
CQR24647      637 QRLLKYEDIFSKKVIANLTR-RHYTGWGRLSAKLINGIKDK HSRKTILDYLI DDG--HSNRNFMQLINDDNL 705
WP_000066813  636 QRLAQYDSLFPDEKVIKALTR-RHYTGWGKLSAKLINGIRDK KSGKTILDYLI DDG---EINRNFMQLIHDDGL 704
WP_009754323  634 QRLAQYDSIFDEKVIKALTR-RHYTGWGKLSAKLINGICDK KTGKTILDYLI DDG---YNNRNFMQLINDDGL 702
WP_044674937  633 KRLEKYKDILTEEQRKKLER-RHYTGWGRLSAKLINGILDK VTRKTILGYLI DDG---TSNRNFMQLINDDTL 701
WP_044676715  635 KRLEKYKDVLTEEQRKKLER-RHYTGWGRLSAKLINGIRDK VTRKTILDYLI DDG---TSNRNFMQLINDDTL 703
WP_044680361  635 KRLEKYKDVLTEEQRKKLER-RHYTGWGRLSAKLINGILDK VTRKTILGYLI DDG---TSNRNFMQLINDDTL 703
WP_044681799  635 KRLEKYKDILTEEQRKKLER-CHYTGWGRLSYKLINGIRNK VTRKTILDYLI DDG---YANRNFMQLINDDAL 701
WP_049533112  613 QRLQKYSDIFTKAQLKKLER-CHYTGWGRLSYKLINGIENK ENKKTILDYLI DDG---QTNENFMQIIRNKDY 682
WP_029090905  638 RKLSEYPQLTEQQQVQLAQV--RPRGWGRLSQRLINRIKTP EDHKLSINEIL ------SRLNLMEIINDKDL 705
AIT42264      634 ERLKTYAHLFDDKVMKQLKR-RRYTGWGRLSRKLINGIRDK QSGKTILDYLI -DGf---ANRNFMQLIHDDSL 702
WP_034440723  638 RQLMKFKDKLSEKAINQLSK-KHYTGWGQLSEKLINGIRDE QSNKTILDYLI DNGcpkNMNRNFMQLINDDTL 710
AKQ21048      634 ERLKTYAHLFDDKVMKQLKR-RRYTGWGRLSRKLINGIRDK QSGKTILDFLK -DGf---ANRNFMQLIHDDSL 702
WP_004636532  644 KQLQTYSDTLSPEILKKLER-KHYTGWGRFSKKLINGLRDE GSNKTILDYLK DEGssgPTNRNFMQLIRDNTL 706
WP_002364836  642 TQLSTFKGGQPSAEVLKKLER-KHYTGWGRLSKKLINGIYDK ESGKTILGYLI DDGvskHYNRNFMQLINDSQL 714
WP_012663104  642 TQLSTFKGGQPSAEVLKKLER-KHYTGWGRLSKKLINGIYDK ESGKTILGYLI DDGvskHYNRNFMQLINDSQL 714
WP_016631044  593 TQLSTFKGGQPSAEVLKKLER-KHYTGWGRLSKKLINGIYDV ESGKTILDYLV DDGvskHYNRNFMQLINDSQL 665
EMS75795      382 TQLKKYQSVLGDGFEKKLVK-KHYTGWGRLSERLINGIRDK KTNKTILDYLI DDDfpyNRNRNFMQLINDSQL 454
WP_002373311  642 TQLSTFKGGQPSAEVLKKLER-KHYTGWGRLSKKLINGIYDK ESGKTILDYLV DDGvskHYNRNFMQLINDSQL 714
WP_002378009  642 TQLSTFKGGQPSAEVLKKLER-KHYTGWGRLSKKLINGIYDK ESGKTILDYLI DDGvskHYNRNFMQLINDSQL 714
WP_002407324  642 TQLSTFKGGQPSAEVLKKLER-KHYTGWGRLSKKLINGIYDK ESGKTILDYLI DDGvskHYNRNFMQLINDSQL 714
WP_002413717  644 TQLSTFKGGQPSAEVLKKLER-KHYTGWGRLSKKLINGIYDK ESGKTILDYLV DDGvskHYNRNFMQLINDSQL 716
WP_010775580  642 TQLSTFKGGQPSEEVLKKLER-KHYTGWGRLSKKLINGIYDK ESGKTILGYLI DDGvskHYNRNFMQLINDSQL 714
WP_010818269  642 TQLSTFKGGQPSAEVLKKLER-KHYTGWGRLSKKLINGIYDK ESGKTILDYLI DDGvskHYNRNFMQLINDSQL 714
WP_010824395  642 TQLSTFKGGQPSAEVLKKLER-KHYTGWGRLSKKLINGIYDK ESGKTILDYLI DDGvskHYNRNFMQLINDSQL 714
WP_016622645  642 TQLSTFKGGQPSAEVLKKLER-KHYTGWGRLSKKLINGIYDK ESGKTILDYLV DDGvskHYNRNFMQLINDSQL 714
WP_033624816  642 TQLSTFKGGQPSAEVLKKLER-KHYTGWGRLSKKLINGIYDK ESGKTILDYLI DDGvskHYNRNFMQLINDSQL 714
WP_033625576  642 TQLSTFKGGQPSEEVLKKLER-KHYTGWGRLSKELINGIYDK ESGKTILDYLI DDGfphHRNRNFMQLINDSQL 714
WP_033789179  642 TQLSTFKGGQPSAEVLKKLER-KHYTGWGRLSRKLINGIYDK ESGKTILDYLI DDGfphHRNRNFMQLINDDSL 714
WP_002310644  643 TRLSHHEATLGKHIIKKLTK-KHYTGWGRLSKELIQGIRDK QSNKTILDYLI DDDfphHRNRNFMQLINDDSL 715
WP_002122694  643 TRLSHHEATLGKHIIKKLTK-KHYTGWGRLSKELIQGIRDK QSNKTILDYLI DDDfphHRNRNFMQLINDDSL 715
WP_002314015  643 TRLSHHEATLGKHIIKKLTK-KHYTGWGRLSKELIQGIRDK QSNKTILDYLI DDDfphHRNRNFMQLINDDSL 715
WP_002220716  643 TRLSHHEATLGKHIIKKLTK-KHYTGWGRLSKELIQGIRDK QSNKTILDYLI DDDfphHRNRNFMQLINDDSL 715
WP_002330729  642 TRLSHHEATLGKHIIKKLTK-KHYTGWGRLSKELIQGIRDK QSNKTILDYLI DDDfphHRNRNFMQLINDDSL 714
WP_002351161  643 TRLSHHEATLGKHIIKKLTK-KHYTGWGRLSKELIQGIRDK KTNKTILDYLI DDDfphHRNRNCMQLINDDSL 715
WP_002345439  643 TRLSHHEATLGKHIIKKLTK-KHYTGWGRLSKELIQGIRDK KTNKTILDYLI DDDvpaNRNRNLMQLINDEHL 715
WP_034867970  638 HQLSKYQEVFGEKLLKEFAR-KHYTGWGRLSAKLINGIKEK KTNKTILDYLI DDDvpaNRNRNLMQLINDEHL 710
WP_034867970  638 HQLSKYQEVFGEKLLKEFAR-KHYTGWGRLSAKLINGIHDK KTNKTILDYLI DDDvpaNRNRNLMQLINDEHL 710
WP_047937432  643 TRLSHHEATLGKHIIKKLTK-KHYTGWGRLSKELIQGIRDK QSNKTILDYLI DDDfphHRNRNFMQLINDDSL 715
WP_010720994  638 HQLSKYQEVFGEKLLKEFAR-KHYTGWGRLSAKLINGIHDK KTNKTILDYLI DDDvpaNRNRNLMQLINDEHL 710
WP_010737004  638 NQLEQLPLNLSTKTIKALSR-RKYTGWGRLSARLIDGIRDK NSGKTILDYLI DESdgyIVNRNFMQLINDDHL 710
WP_072090003  635 EQLKPYETVLGLPAIKKLAK-KHYTGWGRLSEKMIQGMREK QSRKTILDYLI DDDfpcNRNRNFMQLINDDSL 707
WP_023519017  632 EQLKKYTYLFDEEVLKKLER-RHYTGWGRLSAKLLIGIKEK RTHKTILDYLI DDGkqpINRNLMQLINDSDL 704
WP_010770040  635 EQLKKYTYLFDEEVLKKLER-RHYTGWGRLSAKLLIGIKEK RTPETVLEVME DDApkKNINRNLMQLINDNRL 707
WP_048604708  631 EQLKFSDRLSEKTIKDLER-KHYTGWGRLSAKLINGIHDK RTPETVLEVME ------TMMNLMQVINDEKL 703
WP_010750235  637 TQLKKYQRILGEHIFKKLVK-KKYTGWGRLSARLIDGIRDQ KTNKTILDYLI DDDfpyNRNRNFMQLINDDHL 709
AII16583      673 ERLKTYAHLFDDKVMKQLKR-RHYTGWGRLSAKLMGIRDK QSGKTILDFLK -DGf---ANRNFMQLIHDDSL 741
WP_029073316  648 RRLKKEYDLDEEKIKILKLj--KYSGWSRLSKKLLSGIKTK RTPETVLEVME ------TMMNLMQVINDEKL 717
WP_031589969  648 RRLKKEYDLDEEKIKILKLj--KYSGWSRLSKKLLSGIKTK RTPETVLEVME ------TMMNLMQVINDEKL 717
KDA45870      631 RRLENYRDFLGEDILRKLSR-KKYTGWGRLSAKLLTQIVN- KTHKTILDCLM EDYs----QNFMQLINDDTY 698
WP_039099354  651 AKLNEIDWLTDQQRVQLAAK--RYRGWGRLSAKLINGIKEK ANGQRIMDLLW ------TTDNFMRIVHSE-- 712
AKP02966      633 EKLHSSNYSYTSDQIKKISN-MRVKGWGRLSKKLLTCITTE TNTPKSLQLSN -DLm-wTTNNNFISIISNDKY 706
WP_010991369  638 EQLQQFSDVLDGVVLKKLER-RHYTGWGRLSAKLMGIRDK QSHLTILDYLM DDG----LNRNLMQLINDSNL 706
WP_033838504  638 EQLQQFSDVLDGVVLKKLER-RHYTGWGRLSAKLMGIRDK QSHLTILDYLM DDG----LNRNLMQLINDSNL 706
EHN60060      641 EQLQQFSDVLDGVVLKKLER-RHYTGWGRLSAKLMGIRDK QSHLTILDYLM DDG----LNRNLMQLINDSNL 709
```

-continued

```
EFR89594         407  EQLQQFSDVLDGVLDGVULKKLER-RHYTGWGRLSAKLLMGIRDK   QSHLTILDYLM  DDG----LNRNLMQLINDSNL  475
WP_038409211     638  EQLQSFSDVLDGTILKKLER-RHYTGWGRLSAKLLTGIRDK       HSHLTILDYLM  DDG----LNRNLMQLINDSNL  706
EFR95520         257  EQLQSFSDVLDGTILKKLER-RHYTGWGRLSAKLLTGIRDK       HSHLTILDYLM  DDG----LNRNLMQLINDSNL  325
WP_003723650     638  EQLQQFSDVLDGGVLKKLER-RHYTGWGRLSAKLLVGIREK       QSHLTILDYLM  DDG----LNRNLMQLINDSNL  706
WP_003727705     638  EQLQQFSDVLDGVLDGVULKKLER-RHYTGWGRLSAKLLVGIRDK   QSHLTILDYLM  DDG----LNRNLMQLINDSNL  706
WP_003730785     638  EQLQQFSDVLDGVLDGTVULKKLER-RHYTGWGRLSAKLLVGIRDK  QSHLTILDYLM  DDG----LNRNLMQLINDSNL  706
WP_003733029     638  EQLQQFSDVLDGTVLKKLER-RHYTGWGRLSAKLLVGIRDK       QSHLTILDYLM  DDG----LNRNLMQLINDSNL  706
WP_003739838     638  EQLQQFSDVLDGAVLKKLER-RHYTGWGRLSAKLLVGIRDK       QSHLTILDYLM  DDG----LNRNLMQLINDSNL  706
WP_014601172     638  EQLQQFSDVLDGGVLKKLER-RHYTGWGRLSAKLLVGIRDK       QSHLTILDYLM  DDG----LNRNLMQLINDSNL  706
WP_023548323     638  EQLQQFSDVLDGTVLKKLER-RHYTGWGRLSAKLLVGIREK       QSHLTILDYLM  DDG----LNRNLMQLINDSNL  706
WP_031665337     638  EQLQQFSDVLDGTVLKKLER-RHYTGWGRLSAKLLVGIRDK       QSHLTILEYLM  DDG----LNRNLMQLINDSNL  706
WP_031669209     638  EQLQQFSDVLDGTVLKKLER-RHYTGWGRLSAKLLVGIRDK       QSHLTILDYLM  DDG----LNRNLMQLINDSNL  706
WP_033920898     638  EQLQQFSDVLDGTVLKKLER-RHYTGWGRLSAKLLIGIRDK       QSHLTILEYLM  DDG----LNRNLMQLINDSNL  706
AKI42028         641  EQLQQFSDVLDGGVLKKLER-RHYTGWGRLSAKLLVGIREK       QSHLTILDYLM  DDG----LNRNLMQLINDSNL  709
AKI50529          86  EQLQQFSDVLDGVLDGTVULKKLER-RHYTGWGRLSAKLLVGIRDK  QSHLTILDYLM  DDG----LNRNLMQLINDSNL  154
EFR83390         638  ERLQEFSNVLDEAVLKKLER-RHYTGWGRLSAKLLIGIRDK       ESHLTILDYLM  DDK----HNRNLMQLINDSNL  706
WP_046323366     650  ERLKTYAHLFDDKVMKQLKR-RRYTGWGRLSRKLINGIRDK       QSGKTILDFLK  -Dgf---ANRNFMQLIHDDSL  718
AKE81011         642  RRLKKKYALPDDKIKQILKLj--KYKDWSRLSEKLTGMTAD       SV--TVLDVLE  -------SRLNLMEIINDKEL  709
CUO82355         645  RRLKKVYQLDDLLKDIKILKLj--NYTGWSRLSEKLLTGMTAD     KA--TVLFVLE  -------SNKNLMEIINDEKL  712
WP_033162887     667  ERLKTYAHLFDDKVMKQLKR-RRYTGWGRLSRKLINGIRDK       QSGKTILDFLK  -Dgf---ANRNFMQLIHDDSL  735
AGZ01981         634  ERLKTYAHLFDDKVMKQLKR-RRYTGWGRLSRKLINGIRDK       QSGKTILDFLK  -------ANRNFMQLIHDDSL  702
AKA60242         634  ERLKTYAHLFDDKVMKQLKR-RRYTGWGRLSRKLINGIRDK       QSGKTILDFLK  -Dgf---ANRNFMQLIHDDSL  702
AKS40380         638  ERLKTYAHLFDDKVMKQLKR-RRYTGWGRLSRKLINGIRDK       QSGKTILDFLK  -Dgf---ANRNFMQLIHDDSL  706
4UN5_B           638  ERLKTYAHLFDDKVMKQLKR-RRYTGWGRLSRKLINGIRDK       QSGKTILDFLK  -Dgf---ANRNFMQLIHDDSL  706

WP_010922251     703  TFKEDIQKAQVSG-QGDS-LHEHIANLAGSPAIKKGILQTVKKGILQTVKVDELVKVMGIHKPENIVIEMARENQ  TTQKGQKNS  777

WP_039695303     707  PFKQIIQKSQVVG-QGDS-DVDD-IEAVHDLPGSPAIKKGILQSVKIVDELVKVMG-GNPDNIVIEMARENQ     TNRGRSQS   780
WP_045635197     702  SFKEIIQKAQVIG-KTDD-VKQVVQELSGSPAIKKGILQSIKIVDELVKVMG-HAPESIVIEMARENQ         TTARGKKNS  775
5AXW_A           427  VPKKVDLSQQKEI---PT---TLVDDFILSPVVKRSFIQSIKVKVMG---LPNDIIIELAREKN             -------S  487
WP_009880683     387  TFKEDIQKAQVSG-QGDS-LHEHIANLAGSPAIKKGILQTVKKGILQTVKVDELVKVMG-HKPENIVIEMARENQ   TTQKGQKNS  461
WP_010922251     703  TFKEDIQKAQVSG-QGDS-LHEHIANLAGSPAIKKGILQTVKKGILQTVKVDELVKVMG-HKPENIVIEMARENQ   TTQKGQKNS  777
WP_011054416     703  TFKEAIQKAQVSG-QGDS-LHEHIANLAGSPAIKKGILQTVKKGILQTVKVDELVKVMG-HKPENIVIEMARENQ   TTQKGQKNS  777
WP_011284745     703  TFKEDIQKAQVSG-QGDS-LHEHIANLAGSPAIKKGILQTVKKGILQTVKVDELVKVMG-HKPENIVIEMARENQ   TTQKGQKNS  777
WP_011285506     703  TFKEDIQKAQVSG-QGDS-LHEHIANLAGSPAIKKGILQTVKKGILQTVKVDELVKVMG-HKPENIVIEMARENQ   TTQKGQKNS  777
WP_011527619     703  TFKEDIQKAQVSG-QGDS-LHEHIANLAGSPAIKKGILQTVKKGILQTVKVDELVKVMG-HKPENIVIEMARENQ   TTQKGQKNS  777
WP_012560673     703  TFKEDIQKAQVSG-QGHS-LHEHIANLAGSPAIKKGILQTVKKGILQTVKVDELVKVMG-HKPENIVIEMARENQ   TTQKGQKNS  777
WP_014407541     703  TFKEDIQKAQVSG-QGHS-LHEQIANLAGSPAIKKGILQTVKKGILQTVKVDELVKVMG-HKPENIVIEMARENQ   TTQKGQKNS  776
WP_020905136     703  TFKEDIQKAQVSG-QGDS-LHEHIANLAGSPAIKKGILQTVKKGILQTVKVDELVKVMG-HKPENIVIEMARENQ   TTQKGQKNS  777
WP_023080005     703  TFKEDIQKAQVSG-QGDS-LHEHIANLAGSPAIKKGILQTVKKGILQTVKVDELVKVMG-HKPENIVIEMARENQ   TTQKGQKNS  777
WP_023610282     703  TFKEAIQKAQVSG-QGDS-LHEHIANLAGSPAIKKGILQTVKKGILQTVKVDELVKVMG-HKPENIVIEMARENQ   TTQKGQKNS  777
WP_030125963     703  TFKEDIQKAQVSG-QGDS-LHEHIANLAGSPAIKKGILQTVKKGILQTVKVDELVKVMG-HKPENIVIEMARENQ   TTQKGQKNS  777
WP_030126706     703  TFKEDIQKAQVSG-QGDS-LHEHIANLAGSPAIKKGILQTVKKGILQTVKVDELVKVMG-HKPENIVIEMARENQ   TTQKGQKNS  777
WP_031488318     703  TFKEDIQKAQVSG-QGDS-LHEHIANLAGSPAIKKGILQTVKKGILQTVKVDELVKVMG-HKPENIVIEMARENQ   TTQKGQKNS  777
WP_032460140     703  TFKEDIQKAQVSG-QGDS-LHEHIANLAGSPAIKKGILQTVKKGILQTVKVDELVKVMG-HKPENIVIEMARENQ   TTQKGQKNS  777
WP_032461047     703  TFKEDIQKAQVSG-QGDS-LHEHIANLAGSPAIKKGILQTVKKGILQTVKVDELVKVMG-HKPENIVIEMARENQ   TTQKGQKNS  777
WP_032462016     703  TFKEDIQKAQVSG-QGDS-LHEHIANLAGSPAIKKGILQTVKKGILQTVKVDELVKVMG-HKPENIVIEMARENQ   TTQKGQKNS  777
WP_032462936     703  TFKEDIQKAQVSG-QGDS-LHEHIANLAGSPAIKKGILQTVKKGILQTVKVDELVKVMG-HKPENIVIEMARENQ   TTQKGQKNS  776
WP_032464890     703  TFKEDIQKAQVSG-QGHS-LHEHIANLAGSPAIKKGILQTVKKGILQTVKVDELVKVMG-HKPENIVIEMARENQ   TTQKGQKNS  776
WP_033888930     528  TFKEDIQKAQVSG-QGDS-LHEHIANLAGSPAIKKGILQTVKKGILQTVKVDELVKVMG-HKPENIVIEMARENQ   TTQKGQKNS  602
WP_038431314     703  TFKEDIQKAQVSG-QGDS-LHEHIANLAGSPAIKKGILQTVKKGILQTVKVDELVKVMG-HKPENIVIEMARENQ   TTQKGQKNS  777
WP_038432938     703  TFKEDIQKAQVSG-QGDS-LHEHIANLAGSPAIKKGILQTVKKGILQTVKVDELVKVMG-HKPENIVIEMARENQ   TTQKGQKNS  776
WP_038434062     703  TFKEAIQKAQVSG-QGDS-LHEHIANLAGSPAIKKGILQTVKKGILQTVKVDELVKVMG-HKPENIVIEMARENQ   TTQKGQKNS  777
BAQ51233         614  TFKEDIQKAQVSG-QGDS-LHEHIANLAGSPAIKKGILQTVKKGILQTVKVDELVKVMG-HKPENIVIEMARENQ   TTQKGQKNS  688
```

-continued

```
KGE60162
KGE60856
WP_002989955    703  TFKEDIQKAQVSG-QGDS-LHEHIANLAGSPAIKKGILQTVKVVDELVKVMGrHKPENIVIEMARENQ  TTQKGQKNS     777
WP_003030002    704  SFKEEIARAQIIG-DVDD-IANVVHDLPGSPAIKKGILQSVKIVDELVKVMG-HNPANIIEMARENQ   MTDKGRRNS     777
WP_003065552    707  PFKQIIQKSQVVG-DVDD-IEAVVHDLPGSPAIKKGILQSVKIVDELVKVMG-DNPDNIVIEMARENQ  TTNRGRSQS     780
WP_001040076    702  SFKPIIDKARTGS-HSDN-LKEVIGELAGSPAIKKGILQSLKIVDELVKVMG-YEPEQIVVEMARENQ  TTAKGLSRS     775
WP_001040078    705  SFKSIISKAQAGS-HSDN-LKEVVGELAGSPAIKKGILQSLKIVDELVKVMG-YEPEQIVVEMARENQ  TTNQGRRNS     778
WP_001040080    705  SFKSIISKAQAGS-HSDN-LKEVVGELAGSPAIKKGILQSLKIVDELVKVMG-YEPEQIVVEMARENQ  TTNQGRRNS     778
WP_001040081    705  SFKSIISKAQAGS-HSDN-LKEVVGELAGSPAIKKGILQSLKIVDELVKVMG-YEPEQIVVEMARENQ  TTNQGRRNS     778
WP_001040083    705  SFKSIISKAQAGS-HSDN-LKEVVGELAGSPAIKKGILQSLKIVDELVKVMG-YEPEQIVVEMARENQ  TTNQGRRNS     778
WP_001040085    705  SFKSIISKAQAGS-HSDN-LKEVVGELAGSPAIKKGILQSLKIVDELVKVMG-YEPEQIVVEMARENQ  TTNQGRRNS     778
WP_001040087    705  SFKSIISKAQAGS-HSDN-LKEVVGELAGSPAIKKGILQSLKIVDELVKVMG-YEPEQIVVEMARENQ  TTNQGRRNS     778
WP_001040088    705  SFKSIISKAQAGS-HSDN-LKEVVGELAGSPAIKKGILQSLKIVDELVKVMG-YEPEQIVVEMARENQ  TTNQGRRNS     778
WP_001040089    705  SFKSIISKAQAGS-HSDN-LKEVIGELAGSPAIKKGILQSLKIVDELVKVMG-YEPEQIVVEMARENQ  TTNQGRRNS     778
WP_001040090    705  SFKSIISKAQAGS-HSDN-LKEVVGELAGSPAIKKGILQSLKIVDELVKVMG-YEPEQIVVEMARENQ  TTNQGRRNS     778
WP_001040091    705  SFKSIISKAQAGS-HSDN-LKEVVGELAGSPAIKKGILQSLKIVDELVKVMG-YEPEQIVVEMARENQ  TTNQGRRNS     778
WP_001040092    705  SFKSIISKAQSGS-HSDN-LKEVVGELAGSPAIKKGILQSLKIVDELVKVMG-YEPEQIVVEMARENQ  TTNQGRRNS     778
WP_001040094    702  SFKPIIDKARTGS-HSDN-LKEVVGELAGSPAIKKGILQSLKIVDELVKVMG-YEPEQIVVEMARENQ  TTAKGLSRS     775
WP_001040095    705  SFKSIISKAQAGS-HSDN-LKEVVGELAGSPAIKKGILQSLKIVDELVKVMG-YEPEQIVVEMARENQ  TTNQGRRNS     778
WP_001040096    705  SFKSIISKAQAGS-HSDN-LKEVVGELAGSPAIKKGILQSLKIVDELVKVMG-YEPEQIVVEMARENQ  TTAKGLSRS     778
WP_001040097    702  SFKPIIDKARTGS-HLDN-LKEVVGELAGSPAIKKGILQSLKIVDELVKVMG-YEPEQIVVEMARENQ  TTAKGLSRS     775
WP_001040098    702  SFKPIIDKARTGS-HSDN-LKEVVGELAGSPAIKKGILQSLKIVDELVKVMG-YEPEQIVVEMARENQ  TTAKGLSRL     775
WP_001040099    705  SFKSIISKAQAGS-HSDN-LKEVVGELAGSPAIKKGILQSLKIVDELVKVMG-YEPEQIVVEMARENQ  TTNQGRRNS     778
WP_001040100    702  SFKPIIDKARTGS-HSDN-LKEVVGELAGSPAIKKGILQSLKIVDELVKVMG-YEPEQIVVEMARENQ  TTAKGLSRS     775
WP_001040104    702  SFKPIIDKARTGS-HSDN-LKEVVGELAGSPAIKKGILQSLKIVDELVKVMG-YEPEQIVVEMARENQ  TTAKGLSRS     775
WP_001040105    705  SFKSIISKAQAGS-HSDN-LKEVVGELAGSPAIKKGILQSLKIVDELVKVMG-YEPEQIVVEMARENQ  TTNQGRRNS     778
WP_001040106    705  SFKPIIDKAQAGS-HSDN-LKEVVGELAGSPAIKKGILQSLKIVDELVKVMG-YEPEQVVVEMARENQ  TTNQGRRNT     778
WP_001040107    705  SFKPIIDKAQAGS-HSDN-LKEVVGELAGSPAIKKGILQSLKIVDELVKVMG-YEPEQVVVEMARENQ  TTNQGRRNT     778
WP_001040108    705  SFKPIIDKAQAGS-HSDN-LKEVVGELAGSPAIKKGILQSLKIVDELVKVMG-YEPEQVVVEMARENQ  TTNQGRRNT     778
WP_001040109    705  SFKSIISKAQAGS-HSDN-LKEVVGELAGSPAIKKGILQSLKIVDELVKVMG-YEPEQIVVEMARENQ  TTNQGRRNS     778
WP_001040110    705  SFKSIISKAQAGS-HSDN-LKEVVGELAGSPAIKKGILQSLKIVDELVKVMG-YEPEQIVVEMARENQ  TTNQGRRNS     778
WP_015058523    705  SFKPIIDKARTGS-HSDN-LKEVVGELAGSPAIKKGILQSLKIVDELVKVMG-YEPEQIVVEMARENQ  TTAKGLSRL     775
WP_017643650    702  SFKPIIDKARTGS-HSDN-LKEVVGELAGSPAIKKGILQSLKIVDELVKVMG-YEPEQIVVEMARENQ  TTNQGRRNS     778
WP_017647151    705  SFKSIISKAQAGS-HSDN-LKEVVGELAGSPAIKKGILQSLKIVDELVKVMG-YEPEQIVVEMARENQ  TTNQGRRNS     778
WP_017648376    705  SFKSIISKAQAGS-HSDN-LKEVVGELAGSPAIKKGILQSLKIVDELVKVMG-YEPEQIVVEMARENQ  TTNQGRRNS     778
WP_017649527    705  SFKSIISKAQAGS-HSDN-LKEVVGELAGSPAIKKGILQSLKIVDELVKVMG-YEPEQVVVEMARENQ  TTNQGRRNT     778
WP_017771611    705  SFKSIISKAQAGS-HSDN-LKEVVGELAGSPAIKKGILQSLKIVDELVKVMG-YEPEQIVVEMARENQ  TTNQGRRNS     778
WP_017771984    705  SFKSIISKAQAGS-HSDN-LKEVVGELAGSPAIKKGILQSLKIVDELVKVMG-YEPEQIVVEMARENQ  TTNQGRRNS     778
CFQ25032        705  SFKSIISKAQAGS-HSDN-LKEVVGELAGSPAIKKGILQSLKIVDELVKVMG-YEPEQIVVEMARENQ  TTNQGRRNS     778
CFV16040        705  SFKSIISKAQAGS-HSDN-LKEVVGELAGSPAIKKGILQSLKIVDELVKVMG-YEPEQIVVEMARENQ  TTNQGRRNS     778
KLJ37842        705  SFKSIISKAQAGS-HSDN-LKEVVGELAGSPAIKKGILQSLKIVDELVKVMG-YEPEQIVVEMARENQ  TTNKGRRNT     778
KLJ72361        719  SFKSIISKAQSGS-HSDN-LKEVVGELAGSPAIKKGILQSLKIVDELVKVMG-YEPEQIVVEMARENQ  TTNQGRRNS     792
KLL20707        705  SFKSIISKAQAGS-HSDN-LKEVVGELAGSPAIKKGILQSLKIVDELVKVMG-YEPEQIVVEMARENQ  TTNQGRRNS     778
KLL42645        702  SFKPIIDKARTGS-HSDN-LKEVVGELAGSPAIKKGILQSLKIVDELVKVMG-YEPEQIVVEMARENQ  TTAKGLSRS     775
WP_047207273    705  SFKSIISKAQAGS-HSDN-LKEVVGELAGSPAIKKGILQSLKIVDELVKVMG-YEPEQIVVEMARENQ  TTNQGRRNS     778
WP_047209694    702  SFKPIIDKARTGS-HSDN-LKEVVGELAGSPAIKKGILQSLKIVDELVKVMG-YEPEQIVVEMARENQ  TTNQGRRNS     778
WP_050198062    705  SFKSIISKAQAGS-HSDN-LKEVVGELAGSPAIKKGILQSLKIVDELVKVMG-YEPEQIVVEMARENQ  TTNQGRRNS     778
WP_050201642    705  SFKSIISKAQAGS-HSDN-LKEVVGELAGSPAIKKGILQSLKIVDELVKVMG-YEPEQIVVEMARENQ  TTNQGRRNS     778
WP_050204027    705  SFKPIIDKAQAGS-HSDN-LKEVVGELAGSPAIKKGILQSLKIVDELVKVMG-YEPEQVVVEMARENQ  TTNQGRRNT     778
WP_050881965    705  SFKSIISKAQAGS-HSDN-LKEVVGELAGSPAIKKGILQSLKIVDELVKVMG-YEPEQIVVEMARENQ  TTNQGRRNS     778
WP_050886065    705  SFKSIISKAQAGS-HSDN-LKEVVGELAGSPAIKKGILQSLKIVDELVKVMG-YKPEQIVVEMARENQ  TTNQGRRNS     778
AHN30376        705  SFKSIISKAQAGS-HSDN-LKEVVGELAGSPAIKKGILQSLKIVDELVKVMG-YEPEQIVVEMARENQ  TTNQGRRNS     778
EAO78426        705  SFKSIISKAQSGS-HSDN-LKEVVGELAGSPAIKKGILQSLKIVDELVKVMG-YEPEQIVVEMARENQ  TTNQGRRNS     778
CCW42055        705  SFKSIISKAQAGS-HSDN-LKEVVSELAGSPAIKKGILQSLKIVDELVKVMG-YEPEQIVVEMARENQ  TTNQGRRNS     778
```

-continued

```
WP_003041502   704  SFKEEIAKAQAKAQIIG-DVDD-IANVHDLPGSPAIKKGILQSVKIVDELVKVMG-HNPANIIEMARENQ  TTDRGRRNS  777
WP_037593752   705  SFKEEIARAQIIG-DVDD-IANVVHDLPGSPAIKKGILQSVKIVDELVKVMG-HNPANIIEMARENQ    TTDKGRRNS  778
WP_049516684   705  SFKEEIARAQIIG-DVDD-IANVVHDLPGSPAIKKGILQSVKIVDELVKVMG-HNPANIIEMARENQ    TTDKGRRNS  778
GAD46167       704  SFKEEIARAQIIG-DVDD-IANVVHDLPGSPAIKKGILQSVKIVDELVKVMG-HNPANIIEMARENQ    TTDKGRRNS  777
WP_018363470   705  SFKQIIQEAQVVG-DVDD-IETVVHDLPGSPAIKKGILQSVKIVDELIKVMG-DNPDNIVIEMARENQ   TTNRGR.SQS 778
WP_003043819   713  SFKQIIQEAQVSG-QGDS-LHEQIADLAGSPAIKKGILQTVKIVDELVKVMG-HKPENIVIEMARENQ   TTTKGLQQS  786
WP_006269658   704  SFKEEIARAQIID-DVDD-IANVVHDLPGSPAIKKGILQSVKIVDELVKVMG-HNPANIIEMARENQ    TTDKGRRNS  777
WP_048800889   703  PFKQIIKDAQAID-DVDD-ELIVHDLPGSPAIKKGILQSVKIVDELVKVMG-YNPDNIVIEMARENQ    TTTKGRRNS  776
WP_012767106   703  TFKEAIQKAQVSG-QGHS-LHEQIANLAGSPAIKKGILQSVKVVDELVKVMG-HKPENIVIEMARENQ   TTQKGRRNS  776
WP_014612333   703  TFKEAIQKAQVSG-QGHS-LHEQIANLAGSPAIKKGILQSVKIVDELVKVMG-HKPENIVIEMARENQ   TTQKGQKNS  776
WP_015017095   703  TFKEAIQKAQVSG-QGHS-LHEQIANLAGSPAIKKGILQSVKIVDELVKVMG-HKPENIVIEMARENQ   TTQKGQKNS  776
WP_048327215   703  TFKEAIQKAQVSG-QGHS-LHEQIANLAGSPAIKKGILQSVKIVDELVKVMG-HKPENIVIEMARENQ   TTQKGQKNS  776
WP_049519324   703  TFKEAIQKAQVSG-QGHS-LHEQIANLAGSPAIKKGILQSVKIVDELVKVMG-HKPENIVIEMARENQ   TTQKGQKNS  776
WP_012515931   703  SFIDEIAKAQVIG-KTEY-SKDLVGNLAGSPAIKKGISQTIKIVDELVKIMG-YLPQQIVIEMARENQ   TTAQGIKNA  776
WP_021320964   703  SFIDEIAKAQVIG-KTEY-SKDLVGNLAGSPAIKKGISQTIKIVDELVKIMG-YLPQQIVIEMARENQ   TTAQGIKNA  776
WP_037581760   704  SFIDEIAKAQVIG-KTEY-SKDLVGNLAGSPAIKKGISQTIKIVDELVKIMG-YLPQQIVIEMARENQ   TTAQGIKNA  777
WP_004232481   705  SFKTTIQEAQVVG-DVDD-IEAVVHDLPGSPAIKKGILQSVKIVDELVKVMG-HNPQNIVIEMARENQ   ITGYGRRNS  778
WP_009854540   705  PFKQIIQKSQVVG-DIDD-VTSVVRELPGSPAIKKGILQSVKIVDELVKVMG-DNPDNIVIEMARENQ   TTNRGRNQS  778
WP_012962174   707  PFKQIIKDAQIIG-DIDD-VTSVVRELPGSPAIKKGILQSVKIVDELVKVMG-HNPDNIVIEMARENQ   TTNRGRNQS  780
WP_039695303   704  PFKQIIQKSQVVG-DVDD-IEAVVHDLPGSPAIKKGILQSVKIVDELVKVMG-GNPDNIVIEMARENQ   TTNRGRSQS  777
WP_014334983   703  SFKTIIKNEQEKTIKNES-LEETIANLAGSPAIKKGILQSVKIVDEIVKIMG-QNPDNIVIEMARENQ   TTGYGRNKS  777
WP_030992269   703  DFAKIIKNEQEKTIKNES-LEETIANLAGSPAIKKGILQSVKIVDEIVKIMG-QNPDNIVIEMARENQ   STMQGIKNS  777
AHY15608       703  DFAKIIKNEQEKTIKNES-LEETIANLAGSPAIKKGILQSVKIVDEIVKIMG-QNPDNIVIEMARENQ   STMQGIKNS  777
AHY17476            DFAKIIKNEQEKTIKNES-LEETIANLAGSPAIKKGILQSVKIVDEIVKIMG-QNPDNIVIEMARENQ   STMQGIKNS
ESR09100       703  DFAKIIKNEQEKTIKNES-LEETIANLAGSPAIKKGILQSLKIVDEIVKIMG-QNPDNIVIEMARENQ   STMQGIKNS  777
AGM98575       704  SFKEEIAKAQVIG-ETDN-LNQVVSDIAGSPAIKKGILQSLKIVDELVKIMG-HQPENIVEMARENQ    FTNQGRRNS  777
ALF27331            DFKEIIRKAQTIE-NIDT-NQALVSSLPGSPAIKKGILQSLNIVDEIIAIMG-YAPTNIVIEMARENQ   TTNQGRDNS  790
WP_018372492   717  SFKEEIIQKAQVVG-KTND-VKQVVQELPGSPAIKKGILQSIKIVDELVKVMG-HAPESIVIEMARENQ  TTQKGRDNS
WP_045618028   703  SFKEEIIQKAQVVG-KTDD-VKQVVQELSGSPAIKKGILQSLKIVDELVKVMG-HAPESIVIEMARENQ  TTARGKKNS  776
WP_045635197   702  SFKEEIIAKAQVIG-ETDN-LNQVVSDIAGSPAIKKGILQSLKIVDELVKIMG-HQPENIVVEMARENQ  TTARGKKNS  775
WP_002263549   704  SFKEEIAKAQVIG-ETDN-LNQVVSDIAGSPAIKKGILQSLKIVDELVKIMG-HQPENIVVEMARENQ   FTNQGRRNS  777
WP_002263887   704  SFKEEIAKAQVIG-ETDN-LNQVVSDIAGSPAIKKGILQSLKIVDELVKIMG-HQPENIVVEMARENQ   FTNQGRRNS  777
WP_002264920   705  SFKEEIAKAQVIG-ETDN-LNQVVSDIAGSPAIKKGILQSLKIVDELVKIMG-HQPENIVVEMARENQ   FTKQGRRNS  778
WP_002269043   704  SFKEEIAKAQVIG-ETDN-LNQVVSDIAGSPAIKKGILQSLKIVDELVKIMG-HQPENIVVEMARENQ   FTNQGRRNS  777
WP_002269448   704  SFKEEIAKAQVIG-ETDN-LNQVVSDIAGSPAIKKGILQSLKIVDELVKIMG-HQPENIVVEMARENQ   FTNQGRQNS  777
WP_002271977   704  SFKEEIAKAQVIG-ETDN-LNQVVSDIAGSPAIKKGILQSLKIVDELVKIMG-HQPENIVVEMARENQ   FTNQGRRNS  777
WP_002272766   704  SFKEEIAKAQVIG-ETDN-LNQVVSDIAGSPAIKKGILQSLKIVDELVKIMG-HQPENIVVEMARENQ   FTNQGRRNS  777
WP_002273241   704  SFKEEIAKAQVIG-ETDN-LNQVVSDIAGSPAIKKGILQSLKIVDELVKIMG-HQPENIVVEMARENQ   FTKQGRRNS  777
WP_002275430   704  SFKEEIAKAQVIG-ETDN-LNQVVSDIAGSPAIKKGILQSLKIVDELVKIMG-HQPENIVVEMARENQ   FTNQGRRNS  777
WP_002276448   704  SFKEEIAKAQVIG-ETDN-LNQVVSDIAGSPAIKKGILQSLKIVDELVKIMG-HQPENIVVEMARENQ   FTKQGRRNS  777
WP_002277050   705  TFKDDIVKAQVVD-NSDD-LHQVVQSLAGSPAIKKGILQSLKIVDELVKVMG-KEPEQIVVEMARENQ   TTAKGRRNS  778
WP_002773364   704  SFKEEIAKAQVIG-ETDN-LNQVVSDIAGSPAIKKGILQSLKIVDELVKIMG-HQPENIVVEMARENQ   FTNQGRRNS  777
WP_002773705   705  TFKDDIVKAQVVD-NSDD-LHQVVQSLAGSPAIKKGILQSLKIVDELVKVMG-KEPEQIVVEMARENQ   TTAKGRRNS
WP_002279025   704  SFKEEIAKAQVIG-ETDN-LNQVVSDIAGSPAIKKGILQSLKIVDELVKIMG-HQPENIVVEMARENQ   FTNQGRRNS  777
WP_002279859   704  SFKEEIAKAQVIG-ETDN-LNQVVSDIAGSPAIKKGILQSLKIVDELVKIMG-HQPENIVVEMARENQ   FTNQGRRNS  777
WP_002280230   704  SFKEEIAKAQVIG-ETDN-LNQVVSDIAGSPAIKKGILQSLKIVDELVKIMG-HQPENIVVEMARENQ   FTNQGRRNS  777
WP_002281696   704  SFKEEIAKAQVIG-ETDN-LNQVVSDIAGSPAIKKGILQSLKIVDELVKIMG-HQPENIVVEMARENQ   FTKQGRRNS  777
WP_002282247   705  TFKDDIVKAQVVD-NSDD-LHQVVQSLAGSPAIKKGILQSLKIVDELVKVMG-KEPEQIVVEMARENQ   TTAKGRRNS  778
WP_002282906   704  SFKEEIAKAQVIG-ETDN-LNQVVSDIAGSPAIKKGILQSLKIVDELVKIMG-HQPENIVVEMARENQ   FTNQGRRNS  777
WP_002283846   704  SFKEEIAKAQVIG-ETDN-LNQVVSDIAGSPAIKKGILQSLKIVDELVKIMG-HQPENIVVEMARENQ   FTNQGRRNS  777
WP_002872255   704  SFKEEIAKAQVIG-ETDN-LNQVVSDIAGSLAIKKGILQSLKIVDELVKIMG-HQPENIVVEMARENQ   FTNQGRRNS  777
WP_002888990   704  SFKEEIAKAQVIG-ETDN-LNQVVSDIAGSPAIKKGILQSLKIVDELVKIMG-HQPENIVVEMARENQ   FTNQGRRNS  777
WP_002289641   704  SFKEEIAKAQVIG-ETDN-LNQVVSDIAGSPAIKKGILQSLKIVDELVKIMG-HQPENIVVEMARENQ   FTNQGRRNS  777
WP_002290427   704  SFKEEIAKAQVIG-ETDN-LNQVVSDIAGSPAIKKGILQSLKIVDELVKIMG-HQPENIVVEMARENQ   FTNQGRRNS  777
```

-continued

| ID | Seq | End |
|---|---|---|
| WP_002295753 | 704 SFKEEIAKAQVIG-ETDN-LNQVVSDIAGSPAIKKGILQSLKIVDELVKIMG-HQPENIVVEMARENQ FTKQGRRNS | 777 |
| WP_002296423 | 704 SFKEEIAKAQVIG-ETDN-LNQVVSDIAGSPAIKKGILQSLKIVDELVKIMG-HQPENIVVEMARENQ FTNQGRRNS | 777 |
| WP_002304487 | 714 SFKEEIAKAQVIG-EMDG-LNQVVSDIAGSPAIKKGILQSLKIVDELVKVMG-HNPANIVIEMARENQ TTAKGRRSS | 787 |
| WP_002305844 | 704 SFKEEIAKAQVIG-ETDN-LNQVVSDIAGSPAIKKGILQSLKIVDELVKVMG-HNPANIVIEMARENQ TTAKGRRSS | 777 |
| WP_002307203 | 704 SFKEEIAKAQVIG-ETDN-LNQVVSDIAGSPAIKKGILQSLKIVDELVKIMG-HQPENIVVEMARENQ FTNQGRRNS | 777 |
| WP_002310390 | 704 SFKEEIAKAQVIG-ETDN-LNQVVSDIAGSLAIKKGILQSLKIVDELVKIMG-HQPENIVVEMARENQ FTNQGRRNS | 777 |
| WP_002352408 | 704 SFKEEIAKAQVIG-ETDN-LNQVVSDIAGSPAIKKGILQSLKIVDELVKING-HQPENIVVEMARENQ FTNQGQRNS | 777 |
| WP_012997688 | 704 SFKEEIAKAQVIG-ETDN-LNQVVSDIAGSPAIKKGILQSLKIVDELVKIMG-HQPENIVVEMARENQ FTNQGRRNS | 777 |
| WP_014677909 | 704 SFKEEIAKAQVIG-ETDN-LNQVVSDIAGSPAIKKGILQSLKIVDELVKIMG-HQPENIVVEMARENQ FTNQGRRNS | 777 |
| WP_019312892 | 704 SFKEEIAKAQVIG-ETDN-LNQVVSDIAGSPAIKKGILQSLKIVDELVKIMG-HQPENIVVEMARENQ FTNQGRRNS | 777 |
| WP_019313659 | 704 SFKEEIAKAQVIG-ETDN-LNQVVSDIAGSPAIKKGILQSLKIVDELVKVMG-HQPENIVVEMARENQ TTAKGRRNS | 777 |
| WP_019314093 | 704 SFKEEIAKAQVIG-ETDN-LNQVVSDIAGSPAIKKGILQSLKIVDELVKVMG-HQPENIVVEMARENQ FTNQGRRNS | 777 |
| WP_019315370 | 704 SFKEEIAKAQVIG-ETDN-LNQVVSDIAGSPAIKKGILQSLKIVDELVKIMG-HQPENIVVEMARENQ FTNQGRRNS | 778 |
| WP_019803776 | 704 SFKEEIAKAQVIG-ETDN-LNQVVSDIAGSPAIKKGILQSLKIVDELVKIMG-HQPENIVVEMARENQ FTNQGRRNS | 777 |
| WP_019805234 | 704 SFKEEIAKAQVIG-ETDN-LNQVVSDIAGSLAIKKGILQNLKIVDELVKIMG-HQPENIVVEMARENQ FTNQGRRNS | 777 |
| WP_024783594 | 704 SFKEEIAKAQVIG-ETDN-LNQVVSDIAGSPAIKKGILQSLKIVDELVKIMG-HQPENIVVEMARENQ FTNQGRRNS | 777 |
| WP_024784288 | 705 TFKDDIVKAQYVD-NSDD-LHQVVQSLAGSPAIKKGILQSLKIVDELVKVMG-KEPEQIVVEMARENQ FTNQGRRNS | 778 |
| WP_024784666 | 704 SFKEEIAKAQVIG-ETDN-LNQVVSDIAGSPAIKKGILQSLKIVDELVKIMG-HQPENIVVEMARENQ FTNQGRRNS | 777 |
| WP_024784894 | 704 SFKEEIAKAQVIG-ETDN-LNQVVSDIAGSPAIKKGILQSLKIVDELVKVMG-HQPENIVVEMARENQ FTNQGRRNS | 777 |
| WP_024786433 | 705 TFKDDIVKAQYVD-NSDD-LHQVVQSLAGSPAIKKGILQSLKIVDELVKVMG-KEPEQIVVEMARENQ TTAKGRRNS | 778 |
| WP_024786433 | 704 SFKEEIAKAQVIG-ETDN-LNQVVSDIAGSPAIKKGILQSLKIVDELVKIMG-HQPENIVVEMARENQ FTNQGRRNS | 777 |
| WP_049473442 | 704 SFKEEIAKAQVIG-ETDN-LNQVVSDIAGSPAIKKGILQSLKIVDELVKIMG-HQPENIVVEMARENQ FTNQGRRNS | 777 |
| WP_049474547 | 704 SFKEEIAKAQVIG-ETDN-LNQVVSDIAGSPAIKKGILQSLKIVDELVKIMG-HQPENIVVEMARENQ FTNQGRRNS | 777 |
| EMC03581 | 697 SFKEIIKKAQVIG-KTDD-VKQVVSDIAGSIKLVEIMGILQSIKLVDELVKVMG-HEPESIVIEMARENQ TTARGKKNS | 770 |
| WP_000428612 | 705 SFKEIIKKAQVIG-KTDD-VKQVVSDIAGSIKLVEIMGILQSIKLVDELVKVMG-HEPESIVIEMARENQ TTARGKKNS | 778 |
| WP_000428613 | 703 SFKEITQKAQVIG-KTDD-VKQVVQELPGSPAIKKGILQSIKIVDELVKVMG-HTPESIVIEMARENQ TTNKGKSKS | 776 |
| WP_049523028 | 702 SFKEITQKAQVIG-ETND-VKQVVQELPGSPAIKKGILQSIKIVDELVKVMG-HAPESVIEMARENQ TTNKGKSKS | 775 |
| WP_003107102 | 672 DFASIIKEAQEKTiKSEK-LEETIANLAGSPAIKKGILQSIKIVDEVVKVMG-YEPSNIVIEMARENQ STQRGINNS | 746 |
| WP_054279288 | 703 SFKEEIKKAQEGG-LKDS-INDQIRDLAGSPAIKKGILQTINIVDEIVKIMG-KAPQHIVVEMARDVQ KtDIGVKQS | 778 |
| WP_049531101 | 703 SFKEIQESQVVG-KPDD-VKQVVQELPGSSAIKKGILQSIKLVDELVKVMG-HDPESIVIEMARENQ TTARGKKNS | 776 |
| WP_049538452 | 703 SFKEIIQKAQVFG-KTND-VKQVVQELPGSPAIKKGILQSIKIVEELVKVMG-HEPESIVIEMARENQ TTTRGKKNS | 776 |
| WP_049549711 | 703 SFKKIIQKSQVVG-ETDD-VKQVVQELPGSPAIKKGILQSIKIVDELVKVMD-HAPESIVIEMARENQ TTARGKKNS | 776 |
| WP_007896501 | 706 DFEKLIDDAQKKAiKRES-LTEAVANLAGSPAIKKGILQSLKVVDEIVKVMG-HNPDNIVIEMSRENQ TTAQGLKNA | 780 |
| EFR44625 | 658 DFEKLIDDAQKKAiKRES-LTEAVANLAGSPAIKKGILQSLKVVDEIVKVMG-HNPDNIVIEMSRENQ TTAQGLKNA | 732 |
| WP_002897477 | 702 SFKEIIQKAQVVG-KTDD-VKQVVQELPGSPAIKKGILQSIKIVDELVKVMG-YALESIVIEMARENQ TTARGKKNS | 775 |
| WP_002906454 | 702 SFKEIIQKAQVVG-KTDD-VKQVVQELPGSPAIKKGILQSIKIVDELVKVMG-HNPESIVIEMARENQ TTAKGKKNS | 775 |
| WP_009729476 | 702 SFKEIIQKAQVVG-KTDD-VKQVVQELPGSPAIKKGILQSIKIVDELVKVMG-HAPESIVIEMARENQ TTARGKKNS | 776 |
| CQR24647 | 706 SFKDEIANSQVIG-DGDD-LHQVVQELAGSPAIKKGILQSIKIVDELVKVMG-YNPEQIVVEMARENQ TTARGRRNS | 779 |
| WP_000666813 | 705 SFKEIIQKAQVFG-KTND-VKQVVQELPGSPAIKKGILQSIKIVDELVKVMG-HAPESIVVEMARENQ TTARGKKNS | 778 |
| WP_009754323 | 703 SFKEIIQKAQVVG-KTDD-LTQVVRELSGSPAIKKGILQSIKIVDELVKIMG-YAPESIVIEMARENQ TTAKGKKNS | 776 |
| WP_044674937 | 702 SFVDEIRLAQSGS-EAED-YRAEVQNLAGSPAIKKGILQSLKIVDELIEVMG-YDPEHIVVEMARENQ FTNQGRRNS | 775 |
| WP_044676715 | 702 SFVDEIRLAQSGS-EAED-YRAEVQNLAGSPAIKKGILQSLKIVDELIEVMG-YDPEHIVVEMARENQ FTNQGRRNS | 775 |
| WP_044680361 | 702 SFVDEIRLAQSGS-EAED-YRAEVQNLAGSPAIKKGILQSLKIVDELIEVMG-YDPEHIVVEMARENQ FTNQGRRNS | 775 |
| WP_044681799 | 704 SFVDEIRLAQSGS-ETDD-LTQVVRELSGSPAIKKGILQSLKIVDELVKVMG-YNPEAHIVVEMARENQ FTNQGRRNS | 777 |
| WP_049533112 | 683 LFKKIIEEQPENEtALLN--KQRIDELAASPANKGIWQAIKIVKELEKVLQ-QPAENIFIEFARSDE ES----KRS | 752 |
| WP_029090905 | 706 GYAQMIEEATSCPeDGKF-TYEEVERLAGSPALKRGIWQLQIVBEITKVMK-CRPKYIYIEFERSEE ----KERT | 776 |
| WP_006506696 | 703 TFKEDIQKAQVSG-QGDS-LHEHIANLAGSPAIKKGILQTVKVKVMGILRGI-HKPENIVIEMARENQ TTQKGQKNS | 777 |
| AIT42264 | 711 SEKEKIRKAQDIN-QVND-IKEIVKDLPGSPAIKKGILQTVKVKVMGILRKMK-DRPKNIVIEMARENQ TTQEBGKNKS | 784 |
| AKQ21048 | 703 TFKEDIQKAQVSG-QGDS-LHEHIANLAGSPAIKKGILQTVKVMGILRGI-HKPENIVIEMARESQ TTQKGQKNS | 777 |
| WP_004636532 | 707 SFKKKIEDAQTIE-DTTH-IYDTVAELPGSPAIKKGIRQALKIVEEIIDIIG-YEPENIVVEMARESQ TTKKGKDLS | 780 |
| WP_002364836 | 715 SEKNAIQKAQSSE-HEET-LSETVNELAGSPAIKKGIYQSLKIVDELVAIMG-YAPKRIVVEMARENQ TTSTGKRRS | 788 |
| WP_016631044 | 666 SEKNAIQKAQSSE-HEET-LSETVNELAGSPAIKKGIYQSLKIVDELVAIMG-YAPKRIVVEMARENQ TTSTGKRRS | 739 |
| EMS75795 | 455 SFKEELANELALA-GNQS-LLEVEALLGSPAIKKGIWQTLKIVEELIEIIG-YNPKNIVVEMARENQ RT----NRS | 524 |
| WP_002373311 | 715 SEKNAIQKAQSSE-HEET-LSETVNELAGSPAIKKGIYQSLKIVDELVAIMG-YAPKRIVVEMARENQ TTSTGKRRS | 788 |

-continued

| ID | 715-col | seq | end |
|---|---|---|---|
| WP_002378009 | 715 | SEKNAIQKAQSSE-HEET-LSETVNELAGSPAIKKGIYQSLKIVDELVAIMG-YAPKRIVVEMARENQ TTSTGKKRS | 788 |
| WP_002407324 | 715 | SEKNAIQKAQSSE-HEET-LSETVNELAGSPAIKKGIYQSLKIVDELVAIMG-YAPKRIVVEMARENQ TTSTGKKRS | 788 |
| WP_002413717 | 715 | SEKNAIQKAQSSE-HEET-LSETVNELAGSPAIKKGIYQSLKIVDELVAIMG-YAPKRIVVEMARENQ TTSTGKKRS | 788 |
| WP_010775580 | 717 | SEKNAIQKAQSSE-HEET-LSETVNELAGSPAIKKGIYQSLKIVDELVAIMG-YAPKRIVVEMARENQ TTSTGKKRS | 790 |
| WP_010818269 | 715 | SEKNAIQKAQSSE-HEET-LSETVNELAGSPAIKKGIYQSLKIVDELVAIMG-YAPKRIVVEMARENQ TTSTGKKRS | 788 |
| WP_010824395 | 715 | SEKNAIQKAQSSE-HEET-LSETVNELAGSPAIKKGIYQSLKIVDELVAIMG-YAPKRIVVEMARENQ TTSTGKKRS | 788 |
| WP_016622645 | 715 | SEKNAIQKAQSSE-HEET-LSETVNELAGSPAIKKGIYQSLKIVDELVAIMG-YAPKRIVVEMARENQ TTSTGKKRS | 788 |
| WP_036624816 | 715 | SEKNAIQKAQSSE-HEET-LSETVNELAGSPAIKKGIYQSLKIVDELVAIMG-YAPKRIVVEMARENQ TTSTGKKRS | 788 |
| WP_033625576 | 715 | SEKNAIQKAQSSE-HEET-LSETVNELAGSPAIKKGIYQSLKIVDELVAIMG-YAPKRIVVEMARENQ TTSTGKKRS | 788 |
| WP_033789179 | 715 | SEKNAIQKAQSSE-HEET-LSETVNELAGSPAIKKGIYQSLKIVDELVAIMG-YAPKRIVVEMARENQ TTSTGKKRS | 788 |
| WP_002310644 | 715 | SFKKEIKKAQMIT-DTEN-LEEIVKELTGSPAIKKGILQSLKIVDEIVGIMG-YEPANIVVEMARENQ TTGRGLKSS | 788 |
| WP_002112694 | 716 | SFKKEIKKAQMIT-DTEN-LEEIVKELTGSPAIKKGILQSLKIVDEIVGIMG-YEPANIVVEMARENQ TTGRGLKSS | 789 |
| WP_002314015 | 716 | SFKKEIKKAQMIT-DTEN-LEEIVKELTGSPAIKKGILQSLKIVDEIVGIMG-YEPANIVVEMARENQ TTGRGLKSS | 789 |
| WP_002320716 | 716 | SFKKEIKKAQMIT-DTEN-LEEIVKELTGSPAIKKGILQSLKIVDEIVGIMG-YEPANIVVEMARENQ TTGRGLKSS | 789 |
| WP_002330729 | 715 | SFKKEIKKAQMIT-DTEN-LEEIVKELTGSPAIKKGILQSLKIVDEIVGIMG-YEPANIVVEMARENQ TTGRGLKSS | 788 |
| WP_002335161 | 716 | SFKKEIKKAQMIT-DTEN-LEEIVKELTGSPAIKKGILQSLKIVDEIVGIMG-YEPANIVVEMARENQ TTGRGLKSS | 789 |
| WP_002345439 | 716 | SFKKEIKKAQMIT-DTEN-LEEIVKELTGSPAIKKGILQSLKIVDEIVGIMG-YEPANIVVEMARENQ TTGRGLKSS | 789 |
| WP_034867970 | 711 | SFKEEIAKATVFS-KHKS-LVDVIQDLPGSPAIKKGIWQSLKIVEELIAIIG-YKPKNIVIEMARENQ KT---HRT | 780 |
| WP_047937432 | 716 | SFKEEIAKATVFS-KHKS-LVDVIQDLPGSPAIKKGIWQSLKIVEELIAIIG-YKPKNIVIEMARENQ TTGRGLKSS | 789 |
| WP_010720994 | 711 | SFKEEIAKATAFS-KHKS-LVDVIQDLPGSPAIKKGIWQSLKIVEELIAIIG-YKPKNIVIEMARENQ KT---HRT | 780 |
| WP_010737004 | 711 | SFKEEIAKATVFS-KHKS-LVDVIQDLPGSPAIKKGIWQSLKIVEELIAIIG-YKPKNIVIEMARENQ KT---HRT | 780 |
| WP_034700478 | 711 | SFKEEIAKATVFS-KHKS-LVDVIQDLPGSPAIKKGIWQSLKIVEELIAIIG-YKPKNIVIEMARENQ KT---HRT | 780 |
| WP_007209003 | 708 | SFKVIIEDSQPYK-EQQS-AEEIVSELSGSPAIKKGIWQSLKIVEELVAIMG-YKPKNIVVEMARENQ TTGRGKQNS | 781 |
| WP_023519017 | 708 | SFKETIANELIMS-DSNV-LLDQVKAIPGSPAVKKGIWQSIKIVEEIIGIIG-KAPKNIVIEMARENQ RTSR---S | 774 |
| WP_010770040 | 708 | SFKSEIAEAQSDM-NTED-LHEVVQNLAGSPAIKKGILQSLKIVEELVDIMG-SLPKNIVVEMARENQ TTSRGRTNS | 781 |
| WP_048604708 | 704 | TFKEEIEKEQLKA-NSEEsLIEIVQNLAGSPAIKKGIFQSLKIVEELIAIIG-YKPKNIVIEMARENQ TANGRRNS | 778 |
| WP_010750235 | 710 | SFKEEIAKELTLS-DKQS-LLEVEAIPGSPAIKKGIWQTLKIVEEIVAIIG-YKPKNIVIEMARENQ TTTGGKRNS | 783 |
| AII16583 | 742 | TFKEDIQKAQVSG-QGDS-LHEHIANLAGSPAIKKGILQTVKVVDLIVKVMGrHKPENIVVEMARENQ TTQKGQKNS | 816 |
| WP_029073316 | 718 | GFKKTIDDANSTSvSGKF-SYAEVQELAGSPAIKRGIWQALLIVDEIKKIMK-HEPAHVYIEFARNED ----KERK | 788 |
| WP_031589969 | 718 | GFKKTIDDANSTSvSGKF-SYAEVQELAGSPAIKRGIWQALLIVDEIKKIMK-HEPAHVYIEFARNED ----KERK | 788 |
| KDA45870 | 699 | TFKETIKNAQVIE-KEET-LAKTVQELPGSPAIKKGYQSLEIVDEIIKVMG-YKPKSIVVEMARETQ --THGTRKR | 771 |
| AKP02966 | 713 | DFDKLITEANQMM-LAENgVQDVINDLYTSPQNKKALRGILLVNDIQKAMKgQAPERLIEFAREDE VNPRLSVQR | 788 |
| WP_039099354 | 707 | DFKNYIENHNLNKnEDQN-ISNLVNDIHVPALKRGITQGSHIVQEIVEKFPMG-HAPKYIFIEVTRETK TTSRGKRIQ | 785 |
| WP_010991369 | 707 | SFKSIIEKEQVTT-ADKD-IQSIVADLAGSPAIKKGILQSLKIVDELVSVMG-YPPQTIVVEMARENQ TTGKGKNNS | 780 |
| WP_033838504 | 707 | SFKSIIEKEQVTT-ADKD-IQSIVADLAGSPAIKKGILQSLKIVDELVSVMG-YPPQTIVVEMARENQ TTGKGKNNS | 780 |
| EHN60060 | 710 | SFKSIIEKEQVTT-ADKD-IQSIVADLAGSPAIKKGILQSLKIVDELVSVMG-YPPQTIVVEMARENQ TTGKGKNNS | 783 |
| EFR89594 | 476 | SFKSIIEKEQVTT-ADKD-IQSIVADLAGSPAIKKGILQSLKIVDELVSVMG-YPPQTIVVEMARENQ TTNKGKNNS | 549 |
| WP_038409211 | 707 | SFKSIIEKEQVST-ADKG-IQSIVAELAGSPAIKKGILQSLKIVDELVGIMG-YPPQTIVVEMARENQ TTGKGKNNS | 780 |
| EFR95520 | 326 | SFKSIIEKEQVST-ADKG-IQSIVAELAGSPAIKKGILQSLKIVDELVGIMG-YPPQTIVVEMARENQ TTGKGKNNS | 399 |
| WP_003723650 | 707 | SFKSIIEKEQVST-TDKD-LQSIVADLAGSPAIKKGILQSLKIVDELVSIMG-YPPQTIVVEMARENQ TTGKGKNNS | 780 |
| WP_003727705 | 707 | SFKSIIEKEQVTT-TDKD-LQSIVADLAGSPAIKKGILQSLKIVDELVSIMG-YPPQTIVVEMARENQ TTGKGKNNS | 780 |
| WP_003730785 | 707 | SFKSIIEKEQVTT-ADKD-LQSIVADLAGSPAIKKGILQSLKIVDELVSIMG-YPPQTIVVEMARENQ TTGKGKNNS | 780 |
| WP_003733029 | 707 | SFKSIIEKEQVTT-ADKD-LQSIVADLAGSPAIKKGILQSLKIVDELVSIMG-YPPQTIVVEMARENQ TTGKGKNNS | 780 |
| WP_003739838 | 707 | SFKSIIEKEQVST-TDKD-LQSIVADLAGSPAIKKGILQSLKIVDELVSIMG-YPPQTIVVEMARENQ TTGKGKNNS | 780 |
| WP_014601172 | 707 | SFKSIIEKEQVST-ADKD-LQSIVADLAGSPAIKKGILQSLKIVDELVSIMG-YPPQTIVVEMARENQ TTGKGKNNS | 780 |
| WP_023548323 | 707 | SFKSIIEKEQVST-TDKD-LQSIVADLAGSPAIKKGILQSLKIVDELVSIMG-YPPQTIVVEMARENQ TTNKGKNNS | 780 |
| WP_031665337 | 707 | SFKSIIEKEQVST-ADKD-LQSIVADLAGSPAIKKGILQSLKIVDELVSIMG-YPPQTIVVEMARENQ TTVKGKNNS | 780 |
| WP_031669209 | 710 | SFKSIIEKEQVST-TDKD-LQSIVADLAGSPAIKKGILQSLKIVDELVSIMG-YPPQTIVVEMARENQ TTNKGKNNS | 783 |
| WP_033920898 | 710 | SFKSIIEKEQVST-ADKD-LQSIVADLAGSPAIKKGILQSLKVVEELVSIMG-YPPQTIVVEMARENQ TTNKGKNNS | 783 |
| AKI42028 | 707 | SFKSIIEKEQVST-ADKD-LQSIVADLAGSPAIKKGILQSLKIVDELVSIMG-YPPQTIVVEMARENQ TTVKGKNNS | 780 |
| AKI50529 | 155 | SFKSIIEKEQVST-ADKD-LQSIVADLAGSPAIKKGILQSLKIVDELVSIMG-YPPQTIVVEMARENQ TTGKGKNNS | 228 |
| EFR83390 | 707 | SFKSIIEKEQVST-TDKD-LQSIVADLAGSPAIKKGILQSLKIVDELVGIMG-YPPQTIVVEMARENQ TTGKGKNNS | 780 |
| WP_046323366 | 707 | SFKSIIEKEQVST-TDKD-IQSIVADLAGSPAIKKGILQSLKIVDELVGIMG-YPPQTIVVEMARENQ TTGKGKNNS | 780 |
| AKE81011 | 719 | TFKEDIQKAQVSG-QGDS-LHEHIANLAGSPAIKKGILQTVKVVDLIVKVMGrHKPENIVIEMARENQ TTQKGQKNS | 793 |

| ID | | | | | |
|---|---|---|---|---|---|
| CUO82355 | | GYAQMIERASSCPkDGKF | TYEEVAKLAGSPALKRGIWQSLQIVEEITKVMK | CRPKYIYIEFERSEE | -----KERT | 710 780 |
| WP_033162887 | | GYKQIIEESNMQDiEGPF | KYDEVKKLAGSPAIKRGIWQALLVVREITKFMK | HEPSHIYIEFAREEQ | -----KVRK | 713 783 |
| AGZ01981 | | TFKEDIQKAQVSG-QGDS | LHEHIANLAGSPAIKKGILQTVKVVDELVKVMGrHKPENIVIEMARENQ | | TTQKGQKNS | 736 810 |
| AKA60242 | | TFKEDIQKAQVSG-QGDS | LHEHIANLAGSPAIKKGILQTVKVVDELVKVMGrHKPENIVIEMARENQ | | TTQKGQKNS | 703 777 |
| AKS40380 | | TFKEDIQKAQVSG-QGDS | LHEHIANLAGSPAIKKGILQTVKVVDELVKVMGrHKPENIVIEMARENQ | | TTQKGQKNS | 703 777 |
| 4UN5_B | | TFKEDIQKAQVSG-QGDS | LHEHIANLAGSPAIKKGILQTVKVVDELVKVMGrHKPENIVIEMARENQ | | TTQKGQKNS | 707 781 |
| WP_010922251 | RERMKRIEEGIK | ELGS | QILKEHP--VE---NTQLQNEKLYLYLYLQNGRDMYVDQEL--D---INRLSDYDVDHI | | | 778 841 |
| WP_039695303 | QQRLKKLQNSLK | PSYI | E----DK--VE---NSHLQNDQLFLYYIQNGKDMYTGDEL--D---IDHLSDYDIDHI | | | 781 851 |
| WP_045635197 | QQRYKRIEDSLK | ILAS | NILKENP--TD---NNQLQNDRLFLYYIQNGKDMYTGEAL--D---INQLSSYDIDHI | | | 776 843 |
| 5AXW_A | KDAQKMINEMQK | QTNE | EIIRTTGk--E---NAKYLIEKIKLHDMQEGKCLYSLEAIp1EdiLNNPFNYEVDHI | | | 488 561 |
| WP_009880683 | RERMKRIEEGIK | ELGS | DILKEYP--VE---NTQLQNEKLYLYLYLQNGRDMYVDQEL--D---INRLSDYDVDHI | | | 462 525 |
| WP_010922251 | RERMKRIEEGIK | ELGS | QILKEHP--VE---NTQLQNEKLYLYLYLQNGRDMYVDQEL--D---INRLSDYDVDHI | | | 778 841 |
| WP_011054416 | RERMKRIEEGIK | ELGS | QILKEHP--VE---NTQLQNEKLYLYLYLQNGRDMYVDQEL--D---INRLSDYDVDHI | | | 778 841 |
| WP_011284745 | RERMKRIEEGIK | ELGS | QILKEHP--VE---NTQLQNEKLYLYLYLQNGRDMYVDQEL--D---INRLSDYDVDHI | | | 778 841 |
| WP_011285506 | RERMKRIEEGIK | ELGS | QILKEHP--VE---NTQLQNEKLYLYLYLQNGRDMYVDQEL--D---INRLSDYDVDHI | | | 778 841 |
| WP_011527619 | RERMKRIEEGIK | ELGS | DILKEYP--VE---NTQLQNEKLYLYLYLQNGRDMYVDQEL--D---INRLSDYDVDHI | | | 778 841 |
| WP_012560673 | RERMKRIEEGIK | ELGS | DILKEYP--VE---TTQLQNEKLYLYLYLQNGRDMYVDQEL--D---INRLSDYDVDHI | | | 777 840 |
| WP_014407541 | RERMKRIEEGIK | ELGS | DILKEYP--VE---NTQLQNEKLYLYLYLQNGRDMYVDQEL--D---INRLSDYDVDHI | | | 778 841 |
| WP_020905136 | RERMKRIEEGIK | ELGS | QILKEHP--VE---NTQLQNEKLYLYLYLQNGRDMYVDQEL--D---INRLSDYDVDHI | | | 777 840 |
| WP_023080005 | RERMKRIEEGIK | ELGS | QILKEHP--VE---NTQLQNEKLYLYLYLQNGRDMYVDQEL--D---INRLSDYDVDHI | | | 777 840 |
| WP_023610282 | RERMKRIEEGIK | ELGS | DILKEYP--VE---NTQLQNEKLYLYLYLQNGRDMYVDQEL--D---INRLSDYDVDHI | | | 777 840 |
| WP_030125963 | RERMKRIEEGIK | ELGS | DILKEYP--VE---NTQLQNEKLYLYLYLQNGRDMYVDQEL--D---INRLSDYDVDHI | | | 778 841 |
| WP_030126706 | RERMKRIEEGIK | ELGS | DILKEYP--VE---NTQLQNEKLYLYLYLQNGRDMYVDQEL--D---INRLSDYDVDHI | | | 778 841 |
| WP_031488318 | RERMKRIEEGIK | ELGS | DILKEYP--VE---NTQLQNEKLYLYLYLQNGRDMYVDQEL--D---INRLSDYDVDHI | | | 778 841 |
| WP_032460140 | RERMKRIEEGIK | ELGS | DILKEYP--VE---NTQLQNEKLYLYLYLQNGRDMYVDQEL--D---INRLSDYDVDHI | | | 778 841 |
| WP_032461947 | RERMKRIEEGIK | ELGS | DILKEYP--VE---NTQLQNEKLYLYLYLQNGRDMYVDQEL--D---INRLSDYDVDHI | | | 778 841 |
| WP_032462016 | RERMKRIEEGIK | ELGS | DILKEYP--VE---NTQLQNEKLYLYLYLQNGRDMYVDQEL--D---INRLSDYDVDHI | | | 778 841 |
| WP_032462936 | RERMKRIEEGIK | ELGS | QILKEHP--VE---NTQLQNEKLYLYLYLQNGRDMYVDQEL--D---INRLSDYDVDHI | | | 778 841 |
| WP_032464890 | RERMKRIEEGIK | ELGS | QILKEHP--VE---NTQLQNEKLYLYLYLQNGRDMYVDQEL--D---INRLSDYDVDHI | | | 778 841 |
| WP_033888930 | RERMKRIEEGIK | ELGS | DILKEYP--VE---NTQLQNEKLYLYLYLQNGRDMYVDQEL--D---INRLSDYDVDHI | | | 603 666 |
| WP_038431314 | RERMKRIEEGIK | ELGS | DILKEYP--VE---NTQLQNEKLYLYLYLQNGRDMYVDQEL--D---INRLSDYDVDHI | | | 778 841 |
| WP_038432938 | RERMKRIEEGIK | ELGS | DILKEYP--VE---NTQLQNEKLYLYLYLQNGRDMYVDQEL--D---INRLSDYDVDHI | | | 777 840 |
| WP_038434062 | RERMKRIEEGIK | ELGS | DILKEYP--VE---NTQLQNEKLYLYLYLQNGRDMYVDQEL--D---INRLSDYDVDHI | | | 778 841 |
| BAQ51233 | RERMKRIEEGIK | ELGS | ---------------------------QEL--D---INRLSDYDVDHI | | | 689 752 |
| KGE60162 | ------------ | ---- | ---------------------------------------INRLSGYDVDHI | | | 1 16 |
| KGE60856 | | | | | | |
| WP_002989955 | RERMKRIEEGIK | ELGS | QILKEHP--VE---NTQLQNEKLYLYLYLQNGRDMYVDQEL--D---INRLSDYDVDHI | | | 778 841 |
| WP_003030002 | QQRLKKLLQDSLK | PVNI | K-----N--VE---NQQLQNDRLFLYYIQNGKDMYTGETL--D---INNLSQYDIDHI | | | 778 840 |
| WP_003065552 | QQRLKKLQNSLK | PSYI | E----DK--VE---NSHLQNDQLFLYYIQNGKDMYTGDEL--D---IDHLSDYDIDHI | | | 781 851 |
| WP_001040076 | RQRLTTLRESLA | NLKS | EKKPKYV--KDqveNHHLSDDRLFLYYLQNGKDMYTDDEL--D---IDNLSQYDIDHI | | | 776 846 |
| WP_001040078 | RQRYKLLDDGVK | NLAS | NILKEYP--TD---NQALQNERLFLYYLQNGKDMYTGEAL--D---IDNLSQYDIDHI | | | 779 846 |
| WP_001040080 | RQRYKLLDDGVK | NLAS | NILKEYP--TD---NQALQNERLFLYYLQNGKDMYTGEAL--D---IDNLSQYDIDHI | | | 779 846 |
| WP_001040083 | RQRYKLLDDGVK | NLAS | NILKEYP--TD---NQALQNERLFLYYLQNGKDMYTGEAL--D---IDNLSQYDIDHI | | | 779 846 |
| WP_001040085 | RQRYKLLDDGVK | NLAS | NILKEYP--TD---NQALQNERLFLYYLQNGKDMYTGEAL--D---IDDLSQYDIDHI | | | 779 846 |
| WP_001040087 | RQRYKLLDDGVK | NLAS | NILKEYP--TD---NQALQNERLFLYYLQNGKDMYTGEAL--D---IDNLSQYDIDHI | | | 779 846 |
| WP_001040088 | RQRYKLLDDGVK | NLAS | NILKEYP--TD---NQALQNERLFLYYLQNGKDMYTGEAL--D---IDNLSQYDIDHI | | | 779 846 |
| WP_001040089 | RQRYKLLDDGVK | NLAS | NILKEYP--TD---NQALQNERLFLYYLQNGKDMYTGEAL--D---IDNLSQYDIDHI | | | 779 846 |
| WP_001040090 | RQRYKLLDDGVK | NLAS | NILKEYP--TD---NQALQNERLFLYYLQNGKDMYTGEAL--D---IDNLSQYDIDHI | | | 779 846 |
| WP_001040091 | RQRYKLLDDGVK | NLAS | NILKEYP--TD---NQALQNERLFLYYLQNGKDMYTGEAL--D---IDNLSQYDIDHI | | | 779 846 |
| WP_001040092 | RQRYKLLEDGVK | NLAS | DILKEYP--TD---NQALQNERLFLYYLQNGKDMYTGDEL--D---IDNLSQYDIDHI | | | 779 846 |
| WP_001040094 | RQRLTTLRESLA | NLKS | EKKPKYV--KDqveNHHLSDDRLFLYYLQNGKDMYTDDEL--D---IDNLSQYDIDHI | | | 776 846 |

```
                                                              -continued
WP_001040095  776  RQRLTTLRESLA  NLKS  EKKPKV--KDqveNHHLSDDRLFLYYLQNGKDMYTDDEL--D--IDNLSQYDIDHI  846
WP_001040096  776  RQRLTTLRESLA  NLKS  EKKPKV--KDqveNHHLSDDRLFLYYLQNGKDMYTDDEL--D--IDNLSQYDIDHI  846
WP_001040097  776  RQRLTTLRESLA  NLKS  EKKPKV--KDqveNHHLSDDRLFLYYLQNGKDMYTDDEL--D--IDNLSQYDIDHI  846
WP_001040098  776  RQRLTTLRESLA  NLKS  EKKPKV--KDqveNHHLSDDRLFLYYLQNGKDMYTDDEL--D--IDNLSQYDIDHI  846
WP_001040099  776  RQRLTTLRESLA  NLKS  EKKPKV--KDqveNHHLSDDRLFLYYLQNGKDMYTDDEL--D--IDNLSQYDIDHI  846
WP_001040100  776  RQRLTTLRESLA  NLKS  EKKPKV--KDqveNHHLSDDRLFLYYLQNGKDMYTDDEL--D--IDNLSQYDIDHI  846
WP_001040104  779  RQRYKLLDDGVK  NLAS  NILKEYP--TD---NQALQNERLFLYYLQNGRDMYTGEAL--D--IDNLSQYDIDHI  846
WP_001040105  779  RQRYKLLDDGVK  NLAS  NILKEYP--TD---NQALQNERLFLYYLQNGRDMYTGEAL--D--IDNLSQYDIDHI  846
WP_001040106  779  RQRYKLLEEGVK  NLAS  NILKEYP--TD---NQALQNERLFLYYLQNGRDMYTGEAL--D--IDNLSQYDIDHI  846
WP_001040107  779  RQRYKLLEEGVK  NLAS  NILKEYP--TD---NQALQNERLFLYYLQNGRDMYTGEAL--D--IDNLSQYDIDHI  846
WP_001040108  779  RQRYKLLEEGVK  NLAS  NILKEYP--TD---NQALQNERLFLYYLQNGRDMYTGETL--D--IDNLSQYDIDHI  846
WP_001040109  779  RQRYKLLEEGVK  NLAS  NILKEYP--TD---NQALQNERLFLYYLQNGRDMYTGEAL--D--IDNLSQYDIDHI  846
WP_001040110  779  RQRYKLLEEGVK  NLAS  NILKEYP--TD---NQALQNERLFLYYLQNGRDMYTGEAL--D--IDNLSQYDIDHI  846
WP_015058523  776  RQRLTTLRESLA  NLKS  DILKEYP--TD---NQALQNERLFLYYLQNGRDMYTDDEL--D--IDNLSQYDIDLI  846
WP_017643650  779  RQRYKLLDDGVK  NLAS  NILKEYP--TD---NQALQNERLFLYYLQNGRDMYTGKAL--D--IDNLSQYDIDHI  846
WP_017647151  779  RQRYKLLDDGVK  NLAS  NILKEYP--TD---NQALQNERLFLYYLQNGRDMYTGEAL--D--IDNLSQYDIDHI  846
WP_017648376  779  RQRYKLLDDGVK  NLAS  NILKEYP--TD---NQALQNERLFLYYLQNGRDMYTGKAL--D--IDNLSQYDIDHI  846
WP_017649527  779  RQRYKLLDDGVK  NLAS  NILKEYP--TD---NQALQNERLFLYYLQNGRDMYTGEAL--D--IDNLSQYDIDHI  846
WP_017771611  779  RQRYKLLDDGVK  NLAS  NILKEYP--TD---NQALQNERLFLYYLQNGRDMYTGEAL--D--IDNLSQYDIDHI  846
WP_017771984  779  RQRYKLLDDGVK  NLAS  NILKEYP--TD---NQALQNERLFLYYLQNGRDMYTGEAL--D--IDNLSQYDIDHI  846
CFQ25032      779  RQRYKLLDDGVK  NLAS  NILKEYP--TD---NQALQNERLFLYYLQNGRDMYTGEAL--D--IDNLSQYDIDHI  846
CFV16040      779  RQRYKLLDDGVK  NLAS  NILKEYP--TD---NQALQNERLFLYYLQNGRDMYTGEAL--D--IDNLSQYDIDHI  846
KLJ37842      779  RQRYKLLDDGVK  NLAS  NILKEYP--TD---NQALQNERLFLYYLQNGRDMYTGEAL--D--IDNLSQYDIDHI  846
KLJ72361      793  RQRYKLLDDGVK  NLAS  NILKEYP--TD---NQALQNERLFLYYLQNGRDMYTGEAL--D--IDNLSQYDIDHI  860
KLL20707      779  RQRYKLLEEGVK  NLAS  NILKEYP--TD---NQALQNERLFLYYLQNGRDMYTGEAL--D--IDNLSQYDIDHI  846
KLL42645      779  RQRYKLLDDGVK  NLAS  NILKEYP--TD---NQALQNERLFLYYLQNGRDMYTGEAL--D--IDNLSQYDIDHI  846
WP_047207273  776  RQRLTTLRESLA  NLKS  EKKPKV--KDqveNHHLSDDRLFLYYLQNGKDMYTDDEL--D--IDNLSQYDIDHI  846
WP_047209694  779  RQRYKLLDDGVK  NLAS  NILKEYP--TD---NQALQNERLFLYYLQNGRDMYTGEAL--D--IDNLSQYDIDHI  846
WP_050198062  779  RQRYKLLDDGVK  NLAS  NILKEYP--TD---NQALQNERLFLYYLQNGRDMYTGEAL--D--IDNLSQYDIDHI  846
WP_050201642  779  RQRYKLLEEGVK  NLAS  NILKEYP--TD---NQALQNERLFLYYLQNGRDMYTGEAL--D--IDNLSQYDIDHI  846
WP_050204027  779  RQRYKLLDDGVK  NLAS  NILKEYP--TD---NQALQNERLFLYYLQNGRDMYTGEAL--D--IDNLSQYDIDHI  846
WP_050881965  779  RQRYKLLDDGVK  NLAS  NILKEYP--TD---NQALQNERLFLYYLQNGRDMYTGEAL--D--IDNLSQYDIDHI  846
WP_050886065  779  RQRYKLLDDGVK  NLAS  DILKEYP--TD---NQALQNERLFLYYLQNGRDMYTGEAL--D--IDSLSQYDIDHI  846
AHN30376      779  RQRYKLLDDGVK  NLAS  NILKEYP--TD---NQALQNERLFLYYLQNGRDMYTGEAL--D--IDNLSQYDIDHI  846
EAO78426      779  RQRYKLLDDGVR  NLAS  NILKEYP--TD---NQALQNERLFLYYLQNGRDMYTEKAL--D--IDNLSQYDIDHI  846
CCW42055      778  QQRLKLLQDSLK  PVNI  K------N--VE---NQQLQNDRLFLYYIQNGKDMYTGETL--D--INNLSQYDIDHI  840
WP_003041502  779  QQRLKLLQDSLK  PVNI  K------N--VE---NQQLQNDRLFLYYIQNGKDMYTGETL--D--INNLSQYDIDHI  841
WP_037593752  779  QQRLKLLQDSLK  PVNI  K------N--VE---NQQLQNDQLFLYYIQNGKDMYTGETL--D--INNLSQYDIDHI  841
WP_049516684  778  QQRLKLLQNSLK  PSYI  K------DK-VE---NSHLQNDQLFLYYIQNGKDMYTGETL--D--IHHLSQYDIDHI  840
GAD46167      779  RERKKRIEEGIK  ELES  E------DK-VE---NSHLQNDQLFLYYIQNGKDMYTGETL--D--IHHLSQYDIDHI  849
WP_183643470  787  QQRLKLLQDSLT  PVNI  QILKENP--VE---NTQLQNEKLYLYYLQNGRDMYTGETL--D--INRLSDYDIDHI  850
WP_003043819  778  RERMKRIEEGIK  PVSI  K------N--VE---NQQLQNDQLFLYYIQNGKDMYTDDEL--D--INRLSDYDVDHI  840
WP_006269658  777  RERMKRIEEGIK  ELGS  QILKEHP--VE---NTQLQNEKLYLYYLQNGRDMYVDQEL--D--INRLSDYDVDHI  840
WP_048800889  777  RERMKRIEEGIK  ELGS  QILKEHP--VE---NTQLQNEKLYLYYLQNGRDMYVDQEL--D--INRLSDYDVDHI  840
WP_012767106  777  RERMKRIEEGIK  ELGS  QILKEHP--VE---NTQLQNEKLYLYYLQNGRDMYVDQEL--D--INRLSDYDVDHI  840
WP_014612333  777  RERMKRIEEGIK  ELGS  QILKEHP--VE---NTQLQNEKLYLYYLQNGRDMYVDQEL--D--INRLSDYDVDHI  840
WP_015017095  777  RERMKRIEEGIK  ELGS  QILKEHP--VE---NTQLQNEKLYLYYLQNGRDMYVDQEL--D--INRLSDYDVDHI  840
WP_015057649  777  RERMKRIEEGIK  ELGS  QILKEHP--VE---NTQLQNEKLYLYYLQNGRDMYVDQEL--D--INRLSDYDVDHI  840
WP_048327215  777  RERMKRIEEGIK  ELGS  QILKEHP--VE---NTQLQNEKLYLYYLQNGRDMYVDQEL--D--INRLSDYDVDHI  840
WP_049519324  777  RERMKRIEEGIK  ELGS  QILKEHP--VE---NTQLQNEKLYLYYLQNGRDMYVDQEL--D--INRLSDYDVDHI  840
WP_012515931  777  RQRMRKLEETAK  KLGS  NILKEHP--VD---NSQLQNDKRYLYYLQNGKDMYTGDDL--D--IDYLSDYDIDHI  840
WP_021320964  777  RQRMRKLEETAK  KLGS  NILKEHP--VD---NSQLQNDKRYLYYLQNGKDMYTGDDL--D--IDYLSDYDVDHI  840
WP_037581760  777  RQRMRKLEETAK  KLGS  NILKEHP--VD---NSQLQNDKRYLYYLQNGKDMYTGEEL--D--IDYLSSYDIDHI  840
WP_004232481  778  NQRLKRLQDSLK  PSYV  D------SK-VE---NSHLQNDRLFLYYIQNGKDMYTGEEL--D--IDHLSDYDIDHI  848
```

```
WP_009854540    779 QQRLKKLQSSLK PSYI E----DK--VE---NSHLQNDQLFLYYIQNGKDMTGDEL-D--IDHLSDYDIDHI 849
WP_012962174    779 QQRLKKLQDSLK PSYI E----GK--VE---NNHLQDDRLFLYYIQNGKDMTGDEL-D--IDHLSDYDIDHI 849
WP_039695303    781 NQRLKRLQDSLK PSYI E----DK--VE---NSHLQNDQLFLYYIQNGKDMTGDEL-D--IDRLSDYDIDHI 851
WP_014334983    778 RQRLRKLEEVHK PSYV D----SK--VE---NSHLQNDRLFLYYIQNGKDMYTGEEL-D--YDNLSQYDIDHI 848
WP_003099269    778 RQRLRKLEEVHK NTGS    KILKEYN--VS---NTQLQSDRLYLYLLQDGKDMYTGKEL-D--YDNLSQYDIDHI 841
AHY15608        778 RQRLRKLEEVHK NTGS    KILKEYN--VS---NTQLQSDRLYLYLLQDGKDMYTGKEL-D--YDNLSQYDIDHI 841
AHY17476        778 RQRLRKLEEVHK NTGS    KILKEYN--VS---NTQLQSDRLYLYLLQDGKDMYTGKEL-D--YDNLSQYDIDHI 841
ESR09100        ---------    ----                                                           ---
AGM98575        778 RQRLKGLTDSIK NTGS    KILKEYN--VS---NTQLQSDRLYLYLLQDGKDMYTGKEL-D--YDNLSQYDIDHI 841
ALF27331        778 QQRLKGLTDSIK EFGS    QILKEHP--VE---NSQLQNDRLFLYYLQNGRDMYTGEEL-D--IDYLSQYDIDHI 841
WP_018372492    791 AQRLKKIEDGIK -LGS    DLLKQNP--IQd--NKDLQKEKLFLYYMQNGIDLYTGQPLncD--PDSLAFYDVDHI 857
WP_045618028    777 QQRYKRIEDALK NLAH    NILKEHP--TD---NIQLQNDRLFLYLLQNGKDMYTGKSL-D--INQLSSCDIDHI 844
WP_045635197    776 QQRYKRIEDSLK ILAS    NNQLQNDRLFLYYIQNGRDMYTGEAL-D--INQLSYDIDHI (approx)          843
WP_002263549    778 QQRLKGLTDSIK EFGS    QILKEHP--VE---NSQLQNDRLFLYYLQNGRDMYTGEEL-D--IDYLSQYDIDHI 841
WP_002263887    778 QQRLKGLTDSIK EFGS    QILKEHP--VE---NSQLQNDRLFLYYLQNGRDMYTGEEL-D--IDYLSQYDIDHI 841
WP_002264920    778 QQRLKGLTDSIK EFGS    QILKEHP--VE---NSQLQNDRLFLYYLQNGRDMYTGEEL-D--IDYLSQYDIDHI 841
WP_002269043    778 QQRLKGLTDSIK EFGS    QILKEHP--VE---NSQLQNDRLFLYYLQNGRDMYTGEEL-D--IDYLSQYDIDHI 841
WP_002269448    778 QQRLKGLTDSIK EFGS    QILKEHP--VE---NSQLQNDRLFLYYLQNGRDMYTGEEL-D--IDYLSQYDIDHI 841
WP_002271977    778 QQRLKGLTDSIK EFGS    QILKEHP--VE---NSQLQNDRLFLYYLQNGRDMYTGEEL-D--IDYLSQYDIDHI 841
WP_002272766    778 QQRLKGLTDSIK EFGS    QILKEHP--VE---NSQLQNDRLFLYYLQNGRDMYTGEEL-D--IDYLSQYDIDHI 841
WP_002273241    778 QQRLKGLTDSIK EFGS    QILKEHP--VE---NSQLQNDRLFLYYLQNGRDMYTGEEL-D--IDYLSQYDIDHI 841
WP_002275430    778 QQRLKGLTDSIK EFGS    QILKEHP--VE---NSQLQNDRLFLYYLQNGRDMYTGEEL-D--IDYLSQYDIDHI 841
WP_002276448    778 QQRLKGLTDSIK EFGS    QILKEHP--VE---NSQLQNDRLFLYYLQNGRDMYTGEEL-D--IDYLSQYDIDHI 841
WP_002277050    779 QQRYKRLKEAIK DLNH    KILKEHP--TD---NQALQNNRLFLYYLQNGRDMYTGESL-D--INRLSDYDIDHV 846
WP_002277364    778 QQRLKGLTDSIK EFGS    QILKEHP--VE---HSQLQNDRLFLYYLQNGRDMYTGEEL-D--IDYLSQYDIDHI 841
WP_002279025    778 QQRLKGLTDSIK EFGS    QILKEHP--VE---NSQLQNDRLFLYYLQNGRDMYTGEEL-D--IDYLSQYDIDHI 841
WP_002279859    778 QQRLKGLTDSIK EFGS    QILKEHP--VE---NSQLQNDRLFLYYLQNGRDMYTGEEL-D--IDYLSQYDIDHI 841
WP_002280230    778 QQRLKGLTDSIK EFGS    QILKEHP--VE---NSQLQNDRLFLYYLQNGRDMYTGEEL-D--IDYLSQYDIDHI 841
WP_002281696    778 QQRLKGLTDSIK EFGS    QILKEHP--VE---NSQLQNDRLFLYYLQNGRDMYTGEEL-D--IDYLSQYDIDHI 841
WP_002282247    779 QQRYKRLKEAIK DLNH    KILKEHP--TD---NQALQNNRLFLYYLQNGRDMYTGESL-D--INRLSDYDIDHV 846
WP_002282906    778 QQRLKGLTDSIK EFGS    QILKEHP--VE---NSQLQNDRLFLYYLQNGRDMYTGEEL-D--IDYLSQYDIDHI 841
WP_002283846    778 QQRLKGLTDSIK EFGS    QILKEHP--VE---NSQLQNDRLFLYYLQNGRDMYTGEEL-D--IDYLSQYDIDHI 841
WP_002287255    778 QQRLKGLTDSIK EFGS    QILKEHP--VE---NSQLQNDRLFLYYLQNGRDMYTGEEL-D--IDYLSQYDIDHI 841
WP_002288990    778 QQRLKGLTDSIK EFGS    QILKEHP--VE---NSQLQNDRLFLYYLQNGRDMYTGEEL-D--IDYLSQYDIDHI 841
WP_002289641    778 QQRLKGLTDSIK EFGS    QILKEHP--VE---NSQLQNDRLFLYYLQNGRDMYTGEEL-D--IDYLSQYDIDHI 841
WP_002290427    778 QQRLKGLTDSIK EFGS    QILKEHP--VK---NSQLQNDRLFLYYLQNGRDMYTGEEL-D--IDYLSQYDIDHI 841
WP_002295753    778 QQRLKGLTDSIK EFGS    QILKEHP--VE---NSQLQNDRLFLYYLQNGRDMYTGEEL-D--IDYLSQYDIDHI 841
WP_002296423    778 QQRLKGLTDSIK EFGS    QILKEHP--VE---NSQLQNDRLFLYYLQNGRDMYTGEEL-D--IDYLSQYDIDHI 841
WP_003044487    788 QKRYKRLEEAIK DLNH    KILKEHP--TD---NQALQNDRLFLYYLQNGRDMYTEDPL-D--INRLSDYDIDHI 855
WP_003045844    778 QQRLKGLTDSIK EFGS    QILKEHP--VE---NSQLQNDRLFLYYLQNGRDMYTGEEL-D--IDYLSQYDIDHI 841
WP_003072407    778 QQRLKGLTDSIK EFGS    QILKEHP--VE---NSQLQNDRLFLYYLQNGRDMYTGEEL-D--IDYLSQYDIDHI 841
WP_003107203    778 QQRLKGLTDSIK EFGS    QILKEHP--VE---NSQLQNDRLFLYYLQNGRDMYTGEEL-D--IDYLSQYDIDHI 841
WP_002310390    778 QQRLKGLTDSIK EFGS    QILKEHP--VE---NSQLQNDRLFLYYLQNGRDMYTGEEL-D--IDYLSQYDIDHI 841
WP_002352408    778 QQRLKGLTDSIK EFGS    QILKEHP--VE---NSQLQNDRLFLYYLQNGRDMYTGEEL-D--IDYLSQYDIDHI 841
WP_012997688    778 QQRLKGLTDSIK EFGS    QILKEHP--VE---NSQLQNDRLFLYYLQNGRDMYTGEEL-D--IDYLSQYDIDHI 841
WP_014677909    778 QQRLKGLTDSIK EFGS    QILKEHP--VE---NSQLQNDRLFLYYLQNGRDMYTGEEL-D--IDYLSQYDIDHI 841
WP_019312892    778 QQRLKGLTDSIK EFGS    QILKEHP--VE---NSQLQNDRLFLYYLQNGRDMYTGEEL-D--IDYLSQYDIDHI 841
WP_019313659    778 QQRLKGLTDSIK EFGS    QILKEHP--VE---NSQLQNDRLFLYYLQNGRDMYTGEEL-D--IDYLSQYDIDHI 841
WP_019314093    778 QQRLKGLTDSIK EFGS    QILKEHP--VE---NSQLQNDRLFLYYLQNGRDMYTGEEL-D--IDYLSQYDIDHI 841
WP_019315370    778 QQRLKGLTDSIK EFGS    QILKEHP--VE---NSQLQNDRLFLYYLQNGRDMYTGEEL-D--IDYLSQYDIDHI 841
WP_019803776    778 QQRLKGLTDSIK EFGS    QILKEHP--VE---NSQLQNDRLFLYYLQNGRDMYTGEEL-D--IDYLSQYDIDHI 841
WP_019805234    778 QQRLKGLTDSIK EFGS    QILKEHP--VE---NSQLQNDRLFLYYLQNGRDMYTGEEL-D--IDYLSQYDIDHI 841
WP_024783594    779 QQRYKRLKEAIK DLNH    KILKEHP--TD---NQAIQNNRLFLYYLQNGRDMYTGESL-D--INRLSDYDIDHV 846
WP_024784288    779 QQRLKGLTDSIK EFGS    QILKEHP--VE---NSQLQNDRLFLYYLQNGRDMYTGEEL-D--IDYLSQYDIDHI 841
WP_024784666    778 QQRLKGLTDSIK EFGS    QILKEHP--VE---HSQLQNDRLFLYYLQNGRDMYTGEEL-D--IDYLSQYDIDHI 841
```

-continued

-continued

```
WP_024784894  778  QQRLKGLTDSIK  EFGS  QILKEHP--VE---NSQLQNDRLFLYYLQNGRDMTGEEL-D--IDYLSQYDIDHI  841
WP_024786433  779  QQRYKRLKEAIK  DLNH  KILKEHP--TD---NQALQNNRLFLYYLQNGRDMYTGESL-D--INRLSDYDIDHV  846
WP_049473442  778  QQRLKGLTDSIK  EFGS  QILKEHP--VE---NSQLQNDRLFLYYLQNGRDMYTGEEL-D--IDYLSQYDIDHI  841
WP_049474547  771  QQRLKGLTDSIK  EFGS  QILKEHP--VE---NSQLQNDRLFLYYLQNGRDMYTGEEL-D--IDYLSQYDIDHI  834
EMC03581      779  QQRLKGLTDSIK  EFGS  HSQLQNDRLFLYYLQNGRDMYTGEEL-D--IDYLSQYDIDHI  846
WP_000428612  777  QQRYKRIEDSLK  ILAS  KILKEHP--TD---NIQLQNDRLFLYYLQNGRDMYTGKPL-D--INQLSSYDIDHI  844
WP_000428613  776  QQRLKTLSDAIS  NLAS  NILKEHP--TN---NIQLQNDRLFLYYLQNGRDMYTGKPL-D--INQLSNYDIDHI  839
WP_049523028  747  RERLRKLEEVHK  ELG-  KILKEHE--IS---NAQLQSDRVYLYLLLQDGKDMYTGKDL-D--FDRLSQYDIDHI  810
WP_003107102  779  RERMKRVQEVLK  NIGS  QLLKEHP--VE---NFQLQNERLYLYLLQNGKDMYTGEEL-S--ISNLSHYDIDHI  842
WP_054279288  777  QQRYKRIEDSLK  KLGS  NILKEHP--TD---NILKEHP--INHLSSYDIDHI  844
WP_049531101  777  QQRYKRIENSLK  ILAS  KILKEHP--TD---NNQLQNDRLFLYYLQNGRDMYTGEAL-D--INQLSSCDIDHI  844
WP_049538452  777  QQRYKRIEDSLK  ILAS  NILKENP--TD---NNQLQNDRLFLYYLQNGRDMYTGEAL-D--INQLSSCDIDHI  844
WP_049549711  781  RQRLKKIKEVHK  ILAS  NILKEHP--TD---NNQLQNDRLFLYYLQNGRDMYTGEAL-D--INQLSSCDIDHI  846
WP_007896501  733  RQRLKKIKEVHK  KTGS  RILEDNSerIt----NLTLQDNRLYLYILLQDGKDMYTGQDL-D--INNLSQYDIDHI  798
EFR44625      776  QQRYKRIEDALK  NLAP  NILKENP--TD---NIQLKNDRLFLYYLQNGKDMYTGKPL-D--INQLSYDIDHI  843
WP_002997477  777  QQRYKRIEDALK  ILAS  NILKENP--TD---NIQLQNDRLFLYYLQNGKDMYTGKAI-D--INQLSNYDIDHI  844
WP_002906454  780  QQRYKRIEDSLK  DFGS  KILKEHP--TD---NIQLQNDRLFLYYLQNGKDMYTGEAL-D--INQLSSCDIDHI  843
WP_009729476  779  QQRLGSLTKAIQ  NLAS  DILKRYP--VE---NNQLQNDQLYLYLYLQNGRDMYTGDTL-E--INHLSQYDIDHI  846
CQR24647      779  QQRYKRIEDSLK  NLAP  NILKENP--TD---NIQLQNDRLFLYYLQNGRDMYTGKPL-E--IDQLSQYDIDHI  844
WP_000066813  776  QQRYKRIEDALK  NLAP  TISKENP--TD---NIQLQNDRLFLYYLQNGRDMYTDEEL-D--IDQLSQYDIDHI  843
WP_009754323  778  QQRYKKIENAIK  NLNS  KILKEYP--TN---NQALQNDRLFLYYLQNGRDMYTGEAL-D--INNLSQYDIDHI  845
WP_044674937  776  QQRYKRIEDALK  NLNS  NILKENP--TN---NQALQNDRLFLYYLQNGRDMYTGEAL-D--INNLSQYDIDHI  843
WP_044676715  778  QQRYKKIENAIK  NLNS  KILKEYP--TN---NQALQNDRLFLYYLQNGKDMYTDBEL-D--INQLSQYDIDHI  845
WP_044680361  778  QQRYKKIENAIK  PVNI  KILKEYP--TN---NQALQNDRLFLYYLQNGKDMYTDEEL-D--IDQLSQYDIDHI  845
WP_044681799  776  QQRLKLLQDSLK  ETDT  K----N--VE---NQQLQNDRLFLYYLQNGRDMYTGETL-D--INNLSQYDIDHI  843
WP_049533112  778  TPRDKFIEKAYA  DEQT  EHLKELK--Qr--SKQLSSQRLFLYFIQNGKCMYSGEHL-D--IERLDSYEVDHI  840
WP_029090905  753  ESKIKKLENNYK  ELGS  SVLEELKg-FDn-TKKISSDSLFLYFTQLGKCMYSGKKL-D--ISLDKYQIDHI  823
AIT42264      777  RERMKRIEEGIK  NLDS  QILKEHP--VE---NTQLQNEKLYLYLYLQNGRDMVDQEL-D--INRLSDYDVDHI  849
WP_034440723  785  KARLKKIQEGLE  EFGS  HVEKQAL--D----EEMLKSPKYYLYCLQNGKDIYTGKDL-D--IGQLQTYDIDHI  848
AKQ21048      778  RERMKRIEEGIK  EFPDG  --VKVKD--LK---NENLRNDRLYLYLYLQNGRDMVDQEL-D--INRLSKYDIDHI  841
WP_002636532  781  KERLEKLTERIK  EIGS  NLLKEQP--TT---NEQLRDTRLFLYMQNGKDMYTGDEL-S--LHRLSHYDIDHI  845
WP_002364836  789  IQRLKIVEKAMA  EIGS  NLLKEQP--TT---NEQLRDTRLFLYMQNGKDMYTGDEL-S--LHRLSHYDIDHI  852
WP_016631044  789  IQRLKIVEKAMA  SFDS  PLLKEQP--VD---NQALQKDRLYLYLFIQNGKCMYSGEHL-D--IDRLSEYDIDHI  803
EMS75795      525  KPRLKALEEALK  EIGS  NLLKEQP--TT---NEQLRDTRLFLYMQNGKDMYTGDEL-S--LHRLSHYDIDHI  588
WP_002373311  789  IQRLKIVEKAMA  EIGS  NLLKEQP--TT---NEQLRDTRLFLYMQNGKDMYTGDEL-S--LHRLSHYDIDHI  852
WP_002378009  789  IQRLKIVEKAMA  EIGS  NLLKEQP--TT---NEQLRDTRLFLYMQNGKDMYTGDEL-S--LHRLSHYDIDHI  852
WP_002407324  789  IQRLKIVEKAMA  EIGS  NLLKEQP--TT---NEQLRDTRLFLYMQNGKDMYTGDEL-S--LHRLSHYDIDHI  852
WP_002413717  791  IQRLKIVEKAMA  EIGS  NLLKEQP--TT---NEQLRDTRLFLYMQNGKDMYTGDEL-S--LHRLSHYDIDHI  854
WP_010775580  789  IQRLKIVEKAMA  EIGS  NLLKEQP--TT---NEQLRDTRLFLYMQNGKDMYTGDEL-S--LHRLSHYDIDHI  852
WP_010812694  789  IQRLKIVEKAMA  EIGS  NLLKEQP--TT---NEQLRDTRLFLYMQNGKDMYTGDEL-S--LHRLSHYDIDHI  852
WP_0102824395 789  IQRLKIVEKAMA  EIGS  NLLKEQP--TT---NEQLRDTRLFLYMQNGKDMYTGDEL-S--LHRLSHYDIDHI  852
WP_016622645  789  IQRLKIVEKAMA  EIGS  NLLKEQP--TT---NEQLRDTRLFLYMQNGKDMYTGDEL-S--LHRLSHYDIDHI  852
WP_033624816  789  IQRLKIVEKAMA  EIGS  NLLKEQP--TT---NEQLRDTRLFLYMQNGKDMYTGDEL-S--LHRLSHYDIDHI  852
WP_033625576  789  IQRLKIVEKAMA  EIGS  NLLKEQP--TT---NEQLRDTRLFLYMQNGKDMYTGDEL-S--LHRLSHYDIDHI  852
WP_033789179  790  RPRLKALEESLK  DFGS  QLLKEYP--TD---NSSLQKDRLYLYLYLQNGRDMYTGAPL-D--IHRLSHYDIDHI  853
WP_002310644  789  RPRLKALEESLK  DFGS  QLLKEYP--TD---NSSLQKDRLYLYLYLQNGRDMYTGAPL-D--IHRLSHYDIDHI  852
WP_002312694  790  RPRLKALEESLK  DFGS  QLLKEYP--TD---NSSLQKDRLYLYLYLQNGRDMYTGAPL-D--IHRLSHYDIDHI  853
WP_002314015  790  RPRLKALEESLK  DFGS  QLLKEYP--TD---NSSLQKDRLYLYLYLQNGRDMYTGAPL-D--IHRLSHYDIDHI  853
WP_002320716  790  RPRLKALEESLK  DFGS  QLLKEYP--TD---NSSLQKDRLYLYLYLQNGRDMYTGAPL-D--IHRLSHYDIDHI  853
WP_002330729  790  RPRLKALEESLK  DFGS  QLLKEYP--TD---NSSLQKDRLYLYLYLQNGRDMYTGAPL-D--IHRLSHYDIDHI  853
WP_002335161  790  RPRLKALEESLK  DFGS  QLLKEYP--TD---NSSLQKDRLYLYLYLQNGRDMYTGAPL-D--IHRLSHYDIDHI  853
WP_002345439  790  RPRLKALEESLK  DFGS  QLLKEYP--TD---NSSLQKDRLYLYLYLQNGRDMYTGAPL-D--IHRLSHYDIDHI  853
WP_034867970  781  SPRLKALENGLK  QIGS  TLLKEQP--TD---NKALQKERLYLYLYLQNGRDMYTGEPL-E--IENLHQEVDHI  844
```

```
                                                         -continued

WP_047937432  790  RPRLKALEESLK  DFGS  QLLKEYP-TD--NSSLQKDRLYLYLYLQNGRDMYTGAPL-D--IHRLSDYDIDHI     853
WP_010720994  781  KPRLKALENGLK  QIGS  TLLKEQP-TD--NKALQKERLYLYLYLQNGRDMYTGEPL-E--IENLHQYEVDHI     844
WP_010737004  781  SPRLKALENGLK  QIGS  TLLKEQP-TD--NKALQKERLYLYLYLQNGRDMYTGEPL-E--IENLHQYEVDHI     844
WP_034700478  781  KPRLKALENGLK  QIGS  TLLKEQP-TD--NKALQKERLYLYLYLQNGRDMYTGEPL-E--IENLHQYEVDHI     844
WP_007209003  782  KPRLKGIENGLK  EFSD  SVLKGSS-ID--NKQLQNDRLYLYLYLQNGRDMYTGHEL-D--IDHLSTYDIDHI     845
WP_023519017  775  KPRLKALEEALK  NIDS  PLLKDYP-TD--NQALQNDRLYLYLYLQNGRDMYTGEPL-E--IHRLSEYDIDHI     838
WP_010770040  782  NPRMKALEEAMR  NLRS  NLLKEYP-TD--NKALQNDRLYLYLYLQNGRDMYTGLDL-S--LHNLSSYDIDHI     845
WP_048604708  779  RPRLKNLEKAID  DLDS  EILKKEHP-VD--NKALQKDRLYLYLYLQNGRDMYTNEEL-D--IHKLSTYDIDHI    842
WP_010750235  784  KPRLKSLEEALK  NFDS  QLLKERP-VD--NQSLQKDRLYLYLYLQNGRDMYTGESL-D--IDRLSEYDIDHI     847
AII16583      817  RERMKRIEEGIK  ELGS  QILKEHP-VE--NTQLQNEKLYLYLYLQNGRDMVDQEL-D--INRLSDYDVDHI     880
WP_029073316  789  DSFVNQMLKLYK  DFED  EANKHLKg-EDa-KSKIRSERLKLYLYTQMGKCMYTGKSL-D--IDRLDTYQVDHI    860
WP_031589969  789  DSFVNQMLKLYK  DFED  EANKHLKg-EDa-KSKIRSERLKLYLYTQMGKCMYTGKSL-D--IDRLDTYQVDHI    860
KDA45870      772  EDRVQQIVKNLK  ELPK  ------P--S--NAELSDERKYLYCLQNGRDMYTGAPL-D--YDHLQFYDVDHI      833
WP_039099354  789  KRQVEBVYQNIS  EL-   EIRNELK---D--LSSERIMLYFLQNGKSLYSEESL-N--IDKLSTYDIDHI           856
AKP02966      786  RLQSKLLNKANG  -LVP  EELKKHKn-D--LSSERIMLYFLQNGKSLYSEESL-N--INKLSNYDIDHI         858
WP_010991369  781  RPRYKSLEKAIK  EFGS  QILKEHP-TD--NQELRNNRLYLYLYLQNGKDMYTGQDL-D--IHNLSNYDIDHI      844
WP_033388504  781  RPRYKSLEKAIK  DFGS  QILKEHP-TD--NQELRNNRLYLYLYLQNGKDMYTGQDL-D--IHNLSNYDIDHI      844
EHN60060      784  RPRYKSLEKAIK  EFGS  QILKEHP-TD--NQELRNNRLYLYLYLQNGKDMYTGQDL-D--IHNLSNYDIDHI      847
EFR89594      550  RPRYKSLEKAIK  EFGS  QILKEHP-TD--NQELRNNRLYLYLYLQNGKDMYTGQDL-D--IHNLSNYDIDHI      613
WP_038409211  781  KPRFISLEKAIK  EFGS  QILKEHP-TD--NQCLKNDRLYLYLYLQNGKDMYTGKEL-D--IHNLSNYDIDHI      844
EFR95520      400  KPRFISLEKAIK  EFGS  QILKEHP-TD--NQCLKNDRLYLYLYLQNGKDMYTGKEL-D--IHNLSNYDIDHI      463
WP_003723650  781  KPRYKSLEKAIK  EFGS  QILKEHP-TD--NQELKNNRLYLYLYLQNGKDMYTGQEL-D--IHNLSNYDIDHI      844
WP_003727705  781  KPRYKSLEKAIK  DFGS  QILKEHP-TD--NQELKNNRLYLYLYLQNGKDMYTGQEL-D--IHNLSNYDIDHI      844
WP_003730785  781  KPRYKSLEKAIK  DFGS  QILKEHP-TD--NQELKNNRLYLYLYLQNGKDIYTGQEL-D--IHNLSNYDIDHI      844
WP_003733029  781  RPRYKSLEKAIK  EFGS  QILKEHP-TD--NQELKNNRLYLYLYLQNGKDMYTGQEL-D--IHNLSNYDIDHI      844
WP_003739838  781  RPRYKSLEKAIK  EFGS  QILKEHP-TD--NQELKNNRLYLYLYLQNGKDMYTGQEL-D--IHNLSNYDIDHI      844
WP_014601172  781  KPRYKSLEKAIK  EFGS  KILKEHP-TD--NQELKNNRLYLYLYLQNGKDMYTGQEL-D--IHNLSNYDIDHI      844
WP_023548323  781  KPRYKSLEKAIK  EFGS  QILKEHP-TD--NQELKNNRLYLYLYLQNGKDMYTGQEL-D--IHNLSNYDIDHI      844
WP_031665337  781  KPRYKSLEKAIK  EFGS  QILKEHP-TD--NQELKNNRLYLYLYLQNGKDMYTGQEL-D--IHNLSNYDIDHI      844
WP_031669209  781  KPRYKSLEKAIK  EFGS  KILKEHP-TD--NQELKNNRLYLYLYLQNGKDMYTGQEL-D--IHNLSNYDIDHI      844
WP_033920898  784  KPRYKSLEKAIK  EFGS  QILKEHP-TD--NQELKNNRLYLYLYLQNGKDMYTGQEL-D--IHNLSNYDIDHI      847
AKI42028      784  KPRYKSLEKAIK  EFGS  QILKEHP-TD--NQELKNNRLYLYLYLQNGKDMYTGQEL-D--IHNLSNYDIDHI      847
AKI50529      229  KPRFTSLEKAIK  EFGS  QILKEHP-VE--NQGLKNDRLYLYLYLQNGKDMYTGQEL-D--IHNLSNYDIDHV      292
EFR83390      781  RPRYKSLEKAIK  ELGS  QILKEHP-VE--NTQLQNEKLYLYLYLQNGKDMYVDQEL-D--INRLSDYDVDHI      844
WP_046323366  794  RERMKRIEEGIK  ELGS  QILKEHP-VE--NTQLQNEKLYLYLYLQNGKDMYVDQEL-D--INRLSDYDVDHI      857
AKE81011      781  ESKIKLENVYK   DEQT  SVLEELKg-FDn-TKKISSDSLFLYFTQLGKCMYSGKKL-D--IDSLDKYQIDHI       853
CUO82355      784  ESKIAKLQKIYE  NLQT  QVYESLKk-EDa-KKRMETDALYLYLYLQMGKSMYSGKPL-D--IDKLSTYQIDHI      855
WP_033162887  811  RERMKRIEEGIK  ELGS  QILKEHP-VE--NTQLQNEKLYLYLYLQNGRDMYVDQEL-D--INRLSDYDVDHI      874
AGZ01981      778  RERMKRIEEGIK  ELGS  QILKEHP-VE--NTQLQNEKLYLYLYLQNGRDMYVDQEL-D--INRLSDYDVDHI      841
AKA60242      778  RERMKRIEEGIK  ELGS  QILKEHP-VE--NTQLQNEKLYLYLYLQNGRDMYVDQEL-D--INRLSDYDVDHI      841
AKS40380      782  RERMKRIEEGIK  ELGS  QILKEHP-VE--NTQLQNEKLYLYLYLQNGRDMYVDQEL-D--INRLSDYDVDHI      845
4UN5_B        782  RERMKRIEEGIK  ELGS  QILKEHP-VE--NTQLQNEKLYLYLYLQNGRDMYVDQEL-D--INRLSDYDVDAI      845

WP_010922251  842  VPQSFLKDDSIDNKVLTRSDKNRG-KSDN--VP  S--EEVVKKMKN-YWRQLLNAKLITQRKFPDNLTKA--ERGGLSE          910

WP_039695303  852  IPQAFIKDDSIDNRVLTSSAKNRG-KSDD--VP  S--LDIVRARKA-EWVRLYKSGLISKRKFPDNLTKA--ERGGLTE          920
WP_045635197  844  IPQAFIKDDSLDNRVLTSSKDNRG-KSDN--VP  S--IEVVQKRKA-FWQQLLDSKLISERKFNNLTKA--ERGGLDE          912
5AXW_A        562  IPRSVSFDNSFNNKVLVKQEEASK-KGNR--TP  FGy-LSSSDSKI-SYETFKKHINLAKGKGRISKTk-KEYLLEE          632
WP_009880683  526  VPQSFLKDDSIDNKVLTRSDKNRG-KSDN--VP  S--EEVVKKMKN-YWRQLLNAKLITQRKFPDNLTKA--ERGGLSE          594
WP_009222251  842  VPQSFLKDDSIDNKVLTRSDKNRG-KSDN--VP  S--EEVVKKMKN-YWRQLLNAKLITQRKFPDNLTKA--ERGGLSE          910
WP_011054416  842  VPQSFLKDDSIDNKVLTRSDKNRG-KSDN--VP  S--EEVVKKMKN-YWRQLLNAKLITQRKFPDNLTKA--ERGGLSE          910
WP_011284745  842  VPQSFLKDDSIDNKVLTRSDKNRG-KSDN--VP  S--EEVVKKMKN-YWRQLLNAKLITQRKFPDNLTKA--ERGGLSE          910
WP_011285506  842  VPQSFLKDDSIDNKVLTRSDKNRG-KSDN--VP  S--EEVVKKMKN-YWRQLLNAKLITQRKFPDNLTKA--ERGGLSE          910
WP_011527619  842  VPQSFLKDDSIDNKVLTRSDKNRG-KSDN--VP  S--EEVVKKMKN-YWRQLLNAKLITQRKFPDNLTKA--ERGGLSE          910
```

-continued

| | | | |
|---|---|---|---|
| WP_012560673 | 842 | VPQSFLKDDSIDNKVLTRSDKNRG-KSDN--VP | S--EEVVKKMKN-YWKQLLNAKLITQRKFDNLTKA--ERGGLSE | 910 |
| WP_014407541 | 841 | VPQSFLKDDSIDNKVLTRSDKNRG-KSDN--VP | S--EEVVKKMKN-YWRQLLNAKLITQRKFDNLTKA--ERGGLSE | 909 |
| WP_020905136 | 842 | VPQSFIKDDSIDNKVLTRSDKNRG-KSDN--VP | S--EEVVKKMKN-YWKQLLNAKLITQRKFDNLTKA--ERGGLSE | 910 |
| WP_023080005 | 841 | VPQSFIKDDSIDNKVLTRSDKNRG-KSDN--VP | S--EEVVKKMKN-YWKQLLNAKLITQRKFDNLTKA--ERGGLSE | 909 |
| WP_023610282 | 841 | VPQSFLKDDSIDNKVLTRSDKNRG-KSDN--VP | S--EEVVKKMKN-YWKQLLNAKLITQRKFDNLTKA--ERGGLSE | 909 |
| WP_030125963 | 842 | VPQSFLKDDSIDNKVLTRSDKNRG-KSDN--VP | S--EEVVKKMKN-YWRQLLNAKLITQRKFDNLTKA--ERGGLSE | 910 |
| WP_030126706 | 842 | VPQSFLKDDSIDNKVLTRSDKNRG-KSDN--VP | S--EEVVKKMKN-YWRQLLNAKLITQRKFDNLTKA--ERGGLSE | 910 |
| WP_031488318 | 842 | VPQSFLKDDSIDNKVLTRSDKNRG-KSDN--VP | S--EEVVKKMKN-YWKQLLNAKLITQRKFDNLTKA--ERGGLSE | 910 |
| WP_032460140 | 842 | VPQSFLKDDSIDNKVLTRSDKNRG-KSDN--VP | S--EEVVKKMKN-YWKQLLNAKLITQRKFDNLTKA--ERGGLSE | 910 |
| WP_032461047 | 842 | VPQSFLKDDSIDNKVLTRSDKNRG-KSDN--VP | S--EEVVKKMKN-YWKQLLNAKLITQRKFDNLTKA--ERGGLSE | 910 |
| WP_032462016 | 842 | VPQSFLKDDSIDNKVLTRSDKNRG-KSDN--VP | S--EEVVKKMKN-YWKQLLNAKLITQRKFDNLTKA--ERGGLSE | 910 |
| WP_032462936 | 842 | VPQSFLKDDSIDNKVLTRSDKNRG-KSDN--VP | S--EEVVKKMKN-YWKQLLNAKLITQRKFDNLTKA--ERGGLSE | 910 |
| WP_032464890 | 842 | VPQSFLKDDSIDNKVLTRSDKNRG-KSDN--VP | S--EEVVKKMKN-YWKQLLNAKLITQRKFDNLTKA--ERGGLSE | 910 |
| WP_033888930 | 667 | VPQSFIKDDSIDNKVLTRSDKNRG-KSDN--VP | S--EEVVKKMKN-YWKQLLNAKLITQRKFDNLTKA--ERGGLSE | 735 |
| WP_038431314 | 842 | VPQSFLKDDSIDNKVLTRSDKNRG-KSDN--VP | S--EEVVKKMKN-YWRQLLNAKLITQRKFDNLTKA--ERGGLSE | 910 |
| WP_038432938 | 841 | VPQSFLKDDSIDNKVLTRSDKNRG-KSDN--VP | S--EEVVKKMKN-YWRQLLNAKLITQRKFDNLTKA--ERGGLSE | 909 |
| WP_038434062 | 842 | VPQSFLKDDSIDNKVLTRSDKNRG-KSDN--VP | S--EEVVKKMKN-YWKQLLNAKLITQRKFDNLTKA--ERGGLSE | 910 |
| BAQ51233 | 753 | VPQSFLKDDSIDNKVLTRSDKNRG-KSDN--VP | S--EEVVKKMKN-YWKQLLNAKLITQRKFDNLTKA--ERGGLSE | 821 |
| KGE60162 | 17 | VPQSFLKDDSIDNKVLTRSDKNRG-KSDN--VP | S--EEVVKKMKN-YWKQLLNAKLITQRKFDNLTKA--ERGGLSE | 85 |
| KGE60856 | | | | |
| WP_002989955 | 842 | VPQSFIKDDSIDNRVLTSSAKNRG-KSDN--VP | S--EEVVKKMKN-YWRQLLNAKLITQRKFDNLTKA--ERGGLSE | 910 |
| WP_003030002 | 841 | IPQAFIKDNSLDNRVLTSSAKNRG-KSDD--VP | S--IEVVHEMKS-FWSKLLSVKLITQRKFDNLTKA--ERGGLTE | 909 |
| WP_003065552 | 852 | IPQAFIKDDSIDNRVLTSSAKNRG-KSDD--VP | S--LDIVRARLA-EWVRLYKSGLISKRKFDNLTKA--ERGGLTE | 920 |
| WP_001040076 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040078 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040080 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040081 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040083 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040085 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040087 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040088 | 847 | IPQAFIKDDSIDNRVLVSSAKNRG-KSDD--VP | S--IDIVKARKA-FWKKLLDAKLISQRKYDNLTKA--ERGGLTP | 915 |
| WP_001040089 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040090 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040091 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040092 | 847 | IPQAFIKDDSIDNRVLVSSAKNRG-KSDD--VP | S--VEIVKDCKV-FWKKLLDAKLMSQRKYDNLTKA--ERGGLTS | 915 |
| WP_001040094 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040095 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040096 | 847 | IPQAFIKDDSIDNRVLVSSAKNRG-KSDD--VP | S--VEIVKDCKV-FWKKLLDAKLMSQRKYDNLTKA--ERGGLTS | 915 |
| WP_001040097 | 847 | IPQAFIKDDSIDNRVLVSSAKNRG-KSDD--VP | S--VEIVKDCKV-FWKKLLDAKLMSQRKYDNLTKA--ERGGLTS | 915 |
| WP_001040098 | 847 | VPQAFIKDDSIDNRVLVSSAKNRG-KSDD--VP | S--LEIVKDCKV-FWKKLLDAKLMSQRKYDNLTKA--ERGGLTS | 915 |
| WP_001040099 | 847 | VPQAFIKDDSIDNRVLVSSAKNRG-KSDD--VP | S--LEIVKDCKV-FWKKLLDAKLMSQRKYDNLTKA--ERGGLTS | 915 |
| WP_001040100 | 847 | VPQAFIKDDSIDNRVLVSSAKNRG-KSDD--VP | S--IDIVKARKA-FWKKLLDAKLISQRKYDNLTKA--ERGGLTS | 915 |
| WP_001040104 | 847 | IPQAFIKDDSIDNRVLVSSAKNRG-KSDD--VP | S--IDIVKARKA-FWKKLLDAKLISQRKYDNLTKA--ERGGLTS | 915 |
| WP_001040105 | 847 | IPQAFIKDDSIDNRVLVSSAKNRG-KSDD--VP | S--IDIVKARKA-FWKKLLDAKLISQRKYDNLTKA--ERGGLTS | 915 |
| WP_001040106 | 847 | IPQAFIKDDSIDNRVLVSSAKNRG-KSDD--VP | S--IDIVKARKA-FWKKLLDAKLISQRKYDNLTKA--ERGGLTS | 915 |
| WP_001040107 | 847 | IPQAFIKDDSIDNRVLVSSAKNRG-KSDD--VP | S--IDIVKARKA-FWKKLLDAKLISQRKYDNLTKA--ERGGLTP | 915 |
| WP_001040108 | 847 | IPQAFIKDDSIDNRVLVSSAKNRG-KSDD--VP | S--VEIVKDCKV-FWKKLLDAKLMSQRKYDNLTKA--ERGGLTS | 915 |
| WP_001040109 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040110 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_015058523 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_017643650 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_017647151 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_017648376 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_017649527 | 847 | IPQAFIKDDSIDNRVLVSSAKNRG-KSDD--VP | S--LEIVKDCKV-FWKKLLDAKLMSQRKYDNLTKA--ERGGLTS | 915 |

-continued

```
WP_017771611       847 IPQQAFIKDDSIDNRVLVSSAKNRG-KSDN--VP S--IDIVKARKA-FWKKLLDAKLMSQRKYDNLTKA--ERGGLTS 915
WP_017771984       847 IPQAFIKDDSIDNRVLVSSAKNRG-KSDN--VP S--LEIVKDCKV-FWKKLLDAKLMSQRKYDNLTKA--ERGGLTS 915
CFQ25032           847 IPQAFIKDDSIDNRVLVSSAKNRG-KSDD--VP S--LEIVKDCKV-FWKKLLDAKLMSQRKYDNLTKA--ERGGLTS 915
CFV16040           847 IPQAFIKDDSIDNRVLVSSAKNRG-KSDD--VP S--LEIVKDCKV-FWKKLLDAKLMSQRKYDNLTKA--ERGGLTS 915
KLJ37842           847 IPQAFIKDDSIDNRVLVSSAKNRG-KSDD--VP S--LEIVKDCKV-FWKKLLDAKLMSQRKYDNLTKA--ERGGLTS 915
KLJ72361           847 IPQAFIKDDSIDNRVLVSSAKNRG-KSDD--VP S--LEIVKDCKV-FWKKLLDAKLMSQRKYDNLTKA--ERGGLTS 915
KLL20707           861 IPQAFIKDDSIDNRVLVSSAKNRG-KSDD--VP S--LEIVKDCKV-FWKKLLDAKLMSQRKYDNLTKA--ERGGLTS 929
KLL42645           847 IPQAFIKDDSIDNRVLVSSAKNRG-KSDD--VP S--IDIVKARKA-FWKKLLDAKLMSQRKYDNLTKA--ERGGLTS 915
WP_047207273       847 IPQAFIKDDSIDNRVLVSSAKNRG-KSDD--VP S--LEIVKDCKV-FWKKLLDAKLMSQRKYDNLTKA--ERGGLTS 915
WP_047209694       847 IPQAFIKDDSIDNRVLVSSAKNRG-KSDD--VP S--VEIVKDCKV-FWKKLLDAKLMSQRKYDNLTKA--ERGGLTS 915
WP_050198062       847 IPQAFIKDDSIDNRVLVSSAKNRG-KSDD--VP S--LEIVKDCKV-FWKKLLDAKLMSQRKYDNLTKA--ERGGLTS 915
WP_050201642       847 IPQAFIKDDSIDNRVLVSSAKNRG-KSDD--VP S--IDIVKARKA-FWKKLLDAKLMSQRKYDNLTKA--ERGGLTS 915
WP_050204027       847 VPQAFIKDDSIDNRVLVSSAKNRG-KSDD--VP S--IDIVKARKA-FWKKLLDAKLMSQRKYDNLTKA--ERGGLTS 915
WP_050881965       847 IPQAFIKDDSIDNRVLVSSAKNRG-KSDD--VP S--LEIVKDCKV-FWKKLLDAKLISQRKYDNLTKA--ERGGLTS 915
WP_050886065       847 VPQAFIKDDSIDNRVLVSSAKNRG-KSDD--VP S--IDIVKARLA-FWKKLLDAKLISQRKYDNLTKA--ERGGLTP 915
AHN30376           847 IPQAFIKDDSIDNRVLVSSAKNRG-KSDD--VP S--IDIVKARKA-FWKKLLDAKLMSQRKYDNLTKA--ERGGLTS 915
EAO78426           847 IPQAFIKDDSIDNRVLVSSAKNRG-KSDD--VP S--LEIVKDCKV-FWKKLLDAKLMSQRKYDNLTKA--ERGGLTS 915
CCW42055           847 IPQAYIKDDSFDNRVLTSSSENRG-KSDN--VP S--LEIVCARKA-DWMRLRKAGLISQRKFDNLTKA--ERGGLTS 915
WP_003041502       841 IPQAFIKDDSLDNRVLTRSDKNRG-KSDD--VP S--IEVVHEMKS-FWSKLLSVKLITQRKFDNLTKA--ERGGLTE 909
WP_037593752       842 IPQAFIKDDSLDNRVLTRSDKNRG-KSDD--VP S--IEVVHEMKS-FWSKLLSVKLITQRKFDNLTKA--ERGGLTE 910
WP_049516684       842 IPQAFIKDDSLDNRVLTRSDKNRG-KSDD--VP S--IEVVHEMKS-FWSKLLSVKLITQRKFDNLTKA--ERGGLTE 910
GAD46167           841 IPQAFIKDNSLDNRVLTRSDKNRG-KSDD--VP S--IEVVHEMKS-FWSKLLSVKLITQRKFDNLTKA--ERGGLTE 909
WP_018363470       850 VPQSFIKDDSIDNRVLTRSVENRG-KSDD--VP S--LGIVRARKA-EWVRLYKSGLISKRKFDNLTKA--ERGGLTE 918
WP_003043819       851 VPQSFIKDDSIDNRVLTRSVENRG-KSDD--VP S--IEVVKKMKN-YWRQLLNAKLITQRKFDNLTKA--ERGGLSE 919
WP_006269658       841 IPQAFIKDDSIDNRVLTRSDKNRG-KSDD--VP S--IEVVHEMKS-FWSKLLSVKLITQRKFDNLTKA--ERGGLTE 909
WP_048800889       841 IPQSFIKDDSIDNKVLTRSDKNRG-KSDD--VP N--LEVVCDRKA-DWIRLREAGLISQRKFDNLTKA--ERGGLSE 909
WP_012767106       841 VPQSFIKDDSIDNKVLTRSDKNRG-KSDD--VP S--EEVVKKMKN-YWRQLLNAKLITQRKFDNLTKA--ERGGLSE 909
WP_014612333       841 VPQSFIKDDSIDNKVLTRSDKNRG-KSDD--VP S--EEVVKKMKN-YWRQLLNAKLITQRKFDNLTKA--ERGGLSE 909
WP_015017095       841 VPQSFIKDDSIDNKVLTRSDKNRG-KSDD--VP S--EEVVKKMKN-YWRQLLNAKLITQRKFDNLTKA--ERGGLSE 909
WP_015057649       841 VPQSFIKDDSIDNKVLTRSDKNRG-KSDD--VP S--EEVVKKMKN-YWRQLLNAKLITQRKFDNLTKA--ERGGLSE 909
WP_048272215       841 VPQSFIKDDSIDNKVLTSQENRG-KSDD--VP S--EAIVRKMKG-YWQSLLRAGAISKQKFDNLTKA--ERGGLTQ 909
WP_049519324       841 VPQSFIKNNSIDNKVLTSQGANRG-KLDN--VP S--EAIVRKMKG-YWQSLLRAGAISKQKFDNLTKA--ERGGLTQ 909
WP_012515931       841 VPQSFIKNNSIDNKVLTSQGANRG-KSDD--VP S--EAIVRKMKG-YWQSLLRAGAISKQKFDNLTKA--ERGGLTQ 909
WP_021320964       841 IPQSFIKNNSIDNKVLTSQGANRG-KSDD--VP S--EAIVRKMKG-YWYKLYKSGLISKRKFDNLTKA--ERGGLTE 909
WP_037581760       849 IPQSFIKNNSIDNKVLTSSAKNRG-KSDD--VP S--LDIVRARKA-EWVRLYKSGLISKRKFDNLTKA--ERGGLTE 917
WP_004232481       850 IPQAFIKDDSIDNKVLTSSAKNRG-KSDD--VP S--LDIVHDRKA-EWVRLYKSGLISKRKFDNLTKA--ERGGLTE 918
WP_009854540       850 IPQAFIKDDSIDNKVLTSSAKNRG-KSDD--VP S--LDIVRARKA-EWVRLYKSGLISKRKFDNLTKA--ERGGLTE 918
WP_012962174       852 IPQAFIKDDSIDNTVLTTQASNRG-KSDN--VP S--IEIVRNRRS-YWYKLYKSGLISKRKFDNLTKA--ERGGLTE 920
WP_039695303       849 IPQAFIKDNSIDNTVLTTQASNRG-KSDN--VP S--IEIVRNRRS-YWYKLYKSGLISKRKFDNLTKA--ERGGLTE 917
WP_014334983       842 IPQSFIKDNSIDNTVLTTQASNRG-KSDN--VP N--IETVNKMKS-FWYKQLKSGAISQRKFDHLTKA--ERGALSD 910
WP_003099269       842 IPQSFIKDNSIDNTVLTTQASNRG-KSDN--VP N--IETVNKMKS-FWYKQLKSGAISQRKFDHLTKA--ERGALSD 910
AHY15608           842 IPQSFIKDNSIDNTVLTTQASNRG-KSDN--VP N--IETVNKMKS-FWYKQLKSGAISQRKFDHLTKA--ERGALSD 910
AHY17476           842 IPQSFIKDNSIDNTVLTTQASNRG-KSDN--VP N--IETVNKMKS-FWYKQLKSGAISQRKFDHLTKA--ERGALSD 910
ESR09100               ---------------------------------------------------------------------------
AGM98575           842 IPQSFIKDNSIDNTVLTTQASNRG-KSDN--VP N--IETVNKMKS-FWYKQLKSGAISQRKFDHLTKA--ERGALSD 910
ALF27331           842 IPQAFIKDNSIDNTVLTSSKENRG-KSDN--VP S--KDVVRKMKS-YWSKLLSAKLITQRKFDNLTKA--ERGGLTD 910
WP_018372492       858 VPRSYIKNDSFDNKVLTTSKGNRK-KLDD--VP A--KEVVEKMEN-TWRRLHAAGLISDIKLSYLMKGe----LTE 923
WP_045618028       845 IPQAFIKDDSLDNRVLTSSAKNRG-KSDN--VP S--LEIVQKRKA-FWQQLLDSKLISERKFPNLTKA--ERGGLDE 913
WP_045635197       844 IPQAFIKDDSLDNRVLTSSAKNRG-KSDD--VP S--IEVVQKRKA-FWQQLLDSKLISERKFPNLTKA--ERGGLDE 912
WP_002263549       842 IPQAFIKDNSIDNRVLTSSKENRG-KSDN--VP S--KDVVRKMKS-YWSKLLSAKLITQRKFDNLTKA--ERGGLTD 910
WP_002263887       842 IPQAFIKDNSIDNRVLTSSKENRG-KSDN--VP S--KDVVRKMKS-YWSKLLSAKLITQRKFDNLTKA--ERGGLTD 910
WP_002269269       842 IPQAFIKDNSIDNRVLTSSKENRG-KSDD--VP S--KDVVRKMKS-YWSKLLSAKLITQRKFDNLTKG--ERGGLTD 910
WP_002269043       842 IPQAFIKDNSIDNRVLTSSKENRG-KSDD--VP S--KDVVRKMKS-YWSKLLSAKLITQRKFDNLTKA--ERGGLTD 910
WP_002269448       842 IPQAFIKDNSIDNRVLTSSKENRG-KSDN--VP S--EDVVRKMKS-YWSKLLSAKLITQRKFDNLTKA--ERGGLTD 910
```

-continued

| | | | |
|---|---|---|---|
| WP_002271977 | 842 | IPQAFIKDNSIDNRVLTSSKENRG-KSDD--VP S--KDVVRKMKS-YWSKLLSAKLITQRKFDNLTKA--ERGGLTD | 910 |
| WP_002272766 | 842 | IPQAFIKDNSIDNRVLTSSKENRG-KSDD--VP S--KDVVRKMKP-YWSKLLSAKLITQRKFDNLTKA--ERGGLTD | 910 |
| WP_002273241 | 842 | IPQAFIKDNSIDNRVLTSSKENRG-KSDD--VP S--KDVVRKMKS-YWSKLLSAKLITQRKFDNLTKA--ERGGLTD | 910 |
| WP_002275430 | 842 | IPQAFIKDNSIDNRVLTSSKENRG-KSDD--VP S--KDVVRKMKP-YWSKLLSAKLITQRKFDNLTKA--ERGGLTD | 910 |
| WP_002276448 | 842 | IPQAFIKDNSIDNRVLTSSKENRG-KSDD--VP S--KDVVRKMKS-YWSKLLSAKLITQRKFDNLTKA--ERGGLTD | 910 |
| WP_002277050 | 847 | IPQAFIKDNSIDNRVLTSSKANRG-KSDD--VP S--EDVVNRMRP-FWNKLLSSGLISQRKYNNLTKK--E---LTP | 912 |
| WP_002277364 | 842 | IPQAFIKDNSIDNRVLTSSKENRG-KSDD--VP S--KNVVRKMKS-YWSKLLSAKLITQRKFDNLTKA--ERGGLTD | 910 |
| WP_002279025 | 842 | IPQAFIKDNSIDNRVLTSSKENRG-KSDD--VP S--KDVVRKMKP-YWSKLLSAKLITQRKFDNLTKA--ERGGLTD | 910 |
| WP_002279859 | 842 | IPQAFIKDNSIDNRVLTSSKENRG-KSDD--VP S--KDVVRKMKS-YWSKLLSAKLITQRKFDNLTKG--ERGGLTD | 910 |
| WP_002280230 | 842 | IPQAFIKDNSIDNRVLTSSKENRG-KSDD--VP S--KDVVRKMKS-YWSKLLSAKLITQRKFDNLTKA--ERGGLTD | 910 |
| WP_002281696 | 842 | IPQAFIKDNSIDNRVLTSSKENRG-KSDD--VP S--KNVVRKMKS-YWSKLLSAKLITQRKFDNLTKA--ERGGLTD | 910 |
| WP_002282247 | 847 | IPQAFIKDNSIDNRVLTSSKANRG-KSDD--VP S--EDVVNRMRP-FWNKLLSSGLISQRKYNNLTKK--E---LTL | 912 |
| WP_002282906 | 842 | IPQAFIKDNSIDNRVLTSSKENRG-KSDD--VP S--KDVVRKMKS-YWSKLLSAKLITQRKFDNLTKA--ERGGLTD | 910 |
| WP_002283846 | 842 | IPQAFIKDNSIDNRVLTSSKENRG-KSDD--VP S--KNVVRKMKS-YWSKLLSAKLITQRKFDNLTKA--ERGGLTD | 910 |
| WP_002287255 | 842 | IPQAFIKDNSIDNRVLTSSKENRG-KSDD--VP S--KNVVRKMKS-YWSKLLSAKLITQRKFDNLTKA--ERGGLTD | 910 |
| WP_002288990 | 842 | IPQAFIKDNSIDNRVLTSSKENRG-KSDD--VP S--KDVVRKMKS-YWSKLLSAKLITQRKFDNLTKA--ERGGLTD | 910 |
| WP_002289641 | 842 | IPQAFIKDNSIDNRVLTSSKENRG-KSDD--VP S--KDVVRKMKS-YWSKLLSAKLITQRKFDNLTKA--ERGGLTD | 910 |
| WP_002290427 | 842 | IPQAFIKDNSIDNRVLTSSKENRG-KSDD--VP S--KDVVRKMKS-YWSKLLSAKLITQRKFDNLTKG--ERGGLTD | 910 |
| WP_002295753 | 842 | IPQAFIKDNSIDNRVLTSSKENRG-KSDD--VP S--KDVVRKMKS-YWSKLLSAKLITQRKFDNLTKA--ERGGLTD | 910 |
| WP_002296423 | 842 | IPQAFIKDNSIDNRVLTSSKENRG-KSDD--VP S--KNVVRKMKS-YWSKLLSAKLITQRKFDNLTKA--ERGGLTD | 910 |
| WP_002304487 | 856 | IPQAFIKDNSIDNRVLTRSDKNRG-KSDD--VP S--EEVVHKMKP-FWSKLLSAKLITQRKFDNLTKA--ERGGLTD | 924 |
| WP_002305844 | 842 | IPQAFIKDNSIDNRVLTSSKENRG-KSDD--VP S--KDVVRKMKS-YWSKLLSAKLITQRKFDNLTKA--ERGGLTD | 910 |
| WP_002307203 | 842 | IPQAFIKDNSIDNRVLTSSKENRG-KSDD--VP S--KDVVRKMKS-YWSKLLSAKLITQRKFDNLTKA--ERGGLTD | 910 |
| WP_002310390 | 842 | IPQAFIKDNSIDNRVLTSSKENRG-KSDD--VP S--KDVVRKMKS-YWSKLLSAKLITQRKFDNLTKG--ERGGLTD | 910 |
| WP_002352408 | 842 | IPQAFIKDNSIDNRVLTSSKENRG-KSDD--VP S--KDVVRKMKS-YWSKLLSAKLITQRKFDNLTKA--ERGGLTD | 910 |
| WP_012997688 | 842 | IPQAFIKDNSIDNRVLTSSKENRG-KSDD--VP S--KNVVRKMKS-YWSKLLSAKLITQRKFDNLTKA--ERGGLTD | 910 |
| WP_014677909 | 842 | IPQAFIKDNSIDNRVLTSSKENRG-KSDD--VP S--KDVVRKMKS-YWSKLLSAKLITQRKFDNLTKA--ERGGLTD | 910 |
| WP_019312892 | 842 | IPQAFIKDNSIDNRVLTSSKENRG-KSDD--VP S--KNVVRKMKS-YWSKLLSAKLITQRKFDNLTKA--ERGGLTD | 910 |
| WP_019313659 | 842 | IPQAFIKDNSIDNRVLTSSKENRG-KSDD--VP S--KDVVRKMKS-YWSKLLSAKLITQRKFDNLTKA--ERGGLTD | 910 |
| WP_019314093 | 842 | IPQAFIKDNSIDNRVLTSSKENRG-KSDD--VP S--KDVVRKMKS-YWSKLLSAKLITQRKFDNLTKA--ERGGLTD | 910 |
| WP_019315370 | 842 | IPQAFIKDNSIDNRVLTSSKENRG-KSDD--VP S--KDVVRKMKP-YWSKLLSAKLITQRKFDNLTKA--ERGGLTD | 910 |
| WP_019803776 | 842 | IPQAFIKDNSIDNRVLTSSKENRG-KSDD--VP S--KDVVRKMKS-YWSKLLSAKLITQRKFDNLTKA--ERGGLTD | 910 |
| WP_019805234 | 842 | IPQAFIKDNSIDNRVLTSSKENRG-KSDD--VP S--KDVVRKMKS-YWSKLLSAKLITQRKFDNLTKG--ERGGLTD | 910 |
| WP_024783594 | 842 | IPQAFIKDNSIDNRVLTSSKENRG-KSDD--VP S--KDVVRKMKS-YWSKLLSAKLITQRKFDNLTKA--ERGGLTD | 910 |
| WP_024784288 | 847 | IPQAFIKDNSIDNRVLTSSKANRG-KSDD--VP S--EDVVNRMRP-FWNKLLSSGLISQRKYNNLTKK--E---LTL | 912 |
| WP_024784666 | 842 | IPQAFIKDNSIDNRVLTSSKENRG-KSDD--VP S--KNVVRKMKS-YWSKLLSAKLITQRKFDNLTKA--ERGGLTD | 910 |
| WP_024784894 | 842 | IPQAFIKDNSIDNRVLTSSKENRG-KSDD--VP S--KDVVRKMKS-YWSKLLSAKLITQRKFDNLTKA--ERGGLTD | 910 |
| WP_024786433 | 847 | IPQAFIKDNSIDNRVLTSSKANRG-KSDD--VP S--EDVVNRMRP-FWNKLLSSGLISQRKYNNLTKK--E---LTL | 912 |
| WP_049473442 | 842 | IPQAFIKDNSIDNRVLTSSKENRG-KSDD--VP S--KDVVRKMKP-YWSKLLSAKLITQRKFDNLTKA--ERGGLTD | 910 |
| WP_049474547 | 842 | IPQAFIKDNSIDNRVLTSSKENRG-KSDD--VP S--KDVVRKMKS-YWSKLLSAKLITQRKFDNLTKA--ERGGLTD | 910 |
| EMC03581 | 835 | IPQAFIKDNSIDNRVLTSSKENRG-KSDD--VP S--KNVVRKMKS-YWSKLLSAKLITQRKFDNLTKA--ERGGLTD | 903 |
| WP_000428612 | 847 | VPQAFIKDDSLDNRVLTSLKDNRG-KSDN--VP S--LEVVEKMKT-FWQQLLDSKLISYRKFNNLTKA--ERGGLDE | 915 |
| WP_000428613 | 845 | VPQAFIKDDSLDNRVLTSLKDNRG-KSDN--VP S--IEVVQKRKA-FWQQLLDSKLISERKFNNLTKA--ERGGLDE | 913 |
| WP_049523028 | 840 | IPQAFIKDDSLDNRVLTSSKDNRG-KSDN--VP S--LEIVEKMKG-FWQQLLDSKLISERKFNNLTKA--ERGGLDE | 908 |
| WP_003107102 | 811 | IPQSFIKDNSIDNIVLTSQESNRG-KSDN--VP Y--IAIVNKMKS-YWQHQLKSGAISQRKFDNLTKA--ERGGLSE | 879 |
| WP_054279288 | 843 | IPRSFIKDDSIDNKVLTRSEHNRG-KTDN--VP S--IEVVKRMKP-YWQKLLDTKVISQRKFDNLTKA--ERGGLQE | 911 |
| WP_049531101 | 845 | IPQAFIKDDSLDNRVLTSSKDNRG-KSDN--VP S--LEVVQKRKA-FWQQLLESKLISERKFNNLTKA--ERGGLNE | 913 |
| WP_049538452 | 845 | IPQAFIKDDSLDNRVLTSSKENRG-KSDN--VP C--LEVVDKMKV-FWQQLLDFKLISYRKFNNLTKA--ERGGLDE | 913 |
| WP_049549711 | 845 | IPQAFIKDDSLDNRVLTSSKDNRG-KSDN--VP S--LEVVQKRKA-FWQQLLDSKLISERKFNNLTKAerERDGLNE | 915 |
| WP_007896501 | 847 | IPQSFIKDNSIDNLVLTTQKANRG-KSDN--VP S--IEVVRDMKDrVWRRQLANGAISRQKFDHLTKA--ERGGLAD | 916 |
| EFR44625 | 799 | IPQSFIKDNSIDNLVLTTQKANRG-KSDN--VP S--IEVVRDMKDrVWRRQLANGAISRQKFDHLTKA--ERGGLAD | 868 |
| WP_002897477 | 844 | IPQAFIKDDSIDNRVLTSSKDNRG-KSDN--VP S--LEVVQKRKA-FWQQLLDSKLISERKFNNLTKA--ERGGLDE | 912 |
| WP_002906454 | 844 | IPQAFIKDDSLDNRVLTSSKDNRG-KSDN--VP S--IEVVQKRKA-FWQQLLDSKLISERKFNNLTKA--KRGGLDE | 912 |
| WP_009729476 | 845 | IPQAFIKDDSLDNRVLTSSKDNRG-KSDN--VP S--LEVVDKMKV-FWQQLLDSKLISYRKFNNLTKA--ERGGLNE | 913 |

-continued

```
EFR89594          614 VPQSFITDNSIDNLVLTSSAGNRE-KGND--VP P--LEIVQKRKV-FWEKLYQGNLMSKRKFPDYLTKA-ERGGLTE      682
WP_038409211      845 IPQSFITDNSIDNRVLVSSTANRE-KGDN--VP L--LEVVRKRKA-FWEKLYQAKLMSKRKFPDYLTKA-ERGGLTE      913
EFR95520          464 IPQSFITDNSIDNRVLVSSTANRE-KGDN--VP L--LEVVRKRKA-FWEKLYQAKLMSKRKFPDYLTKA-ERGGLTE      532
WP_003723650      845 VPQSFITDNSIDNLVLTSSAGNRE-KGGD--VP P--LEIVRKRKV-FWEKLYQGNLMSKRKFPDYLTKA-ERGGLTE      913
WP_003727705      845 VPQSFITDNSIDNLVLTSSAGNRE-KGGD--VP P--LEIVRKRKV-FWEKLYQGNLMSKRKFPDYLTKA-ERGGLTE      913
WP_003730785      845 VPQSFITDNSIDNLVLTSSAGNRE-KGGD--VP P--LEIVRKRKV-FWEKLYQGNLMSKRKFPDYLTKA-ERGGLTE      913
WP_003733029      845 VPQSFITDNSVDNLVLTSSAGNRE-KGGD--VP P--LEIVQKRKI-FWEKLFQGNLMSKRKFPDYLTKA-ERGGLTE      913
WP_003739838      845 VPQSFITDNSIDNLVLTSSAGNRE-KGGD--VP P--LEIVRKRKV-FWEKLYQGNLMSKRKFPDYLTKA-ERGGLTE      913
WP_014601172      845 VPQSFITDNSIDNLVLTSSAGNRE-KGDN--VP P--LEIVQKRKI-FWEKLYQGNLMSKRKFPDYLTKA-ERGGLTE      913
WP_023548323      845 VPQSFITDNSIDNLVLTSSAGNRE-KGDN--VP P--LEIVRKRKV-FWEKLYQGNLMSKRKFPDYLTKA-ERGGLTD      913
WP_031665337      845 VPQSFITDNSIDNLVLTSSAGNRE-KGGD--VP P--LEIVQKRKI-FWEKLYQGNLMSKRKFPDYLTKA-ERGGLTE      913
WP_031669209      845 VPQSFITDNSIDNVLTSSAGNRE-KGDN--VP P--LEIVQKRKI-FWEKLYQGNLMSKRKFPDYLTKA-ERGGLTE      913
WP_033920898      845 VPQSFITDNSIDNVLTSSAGNRE-KGDN--VP P--LEIVQKRKI-FWEKLYQGNLMSKRKFPDYLTKA-ERGGLTE      913
AKI42028          848 VPQSFITDNSIDNLVLTSSAGNRE-KGGD--VP P--LEIVRKRKI-FWEKLYQGNLMSKRKFPDYLTKA-ERGGLTD      916
AKI50529          848 VPQSFITDNSIDNLVLTSSAGNRE-KGGD--VP P--LEIVQKRKI-FWEKLYQGNLMSKRKFPDYLTKA-ERGGLTE      916
EFR83390          293 VPQSFITDNSIDNLVLTSSAGNRE-KGDN--VP P--LEIVRKRKV-FWEKLYQGNLMSKRKFPDYLTKA-ERGGLTE      361
WP_046323366      845 VPQSFITDNSIDNRVLASSAANRE-KGDN--VP S--LEVVRKRKV-YWEKLYQAKLMSKRKFPDYLTKA-ERGGLTE      913
AKE81011          858 VPQSFLKDDSIDNKVLTRSDKNRG-KSDN--VP S--EEVVKKMKN-YWRQLLNAKLITQRKFPDNLTKA-ERGGLSE      926
CUO82355          854 VPQSFITDNSIDNRVLVLPSENQR-KLDDlvVP ---FDIRDKMYR-FWKLLFDHELISPKKFYSLIKTe----YTE      920
WP_033162887      875 LPQSLIKDDSFDNRVLVLPEENQW-KLDSetVP --FEIRNKMIG-FWQMLHENGLMSNKKPFSLIRTd-----FSD      922
AGZ01981          842 VPQSFLKDDSIDNKVLTRSDKNRG-KSDN--VP S--EEVVKKMKN-YWRQLLNAKLITQRKFPDNLTKA-ERGGLSE      910
AKA60242          842 VPQSFLKDDSIDNKVLTRSDKNRG-KSDN--VP S--EEVVKKMKN-YWRQLLNAKLITQRKFPDNLTKA-ERGGLSE      910
AKS40380          842 VPQSFLKDDSIDNKVLTRSDKNRG-KSDN--VP S--EEVVKKMKN-YWRQLLNAKLITQRKFPDNLTKA-ERGGLSE      910
4UN5_B            846 VPQSFLKDDSIDNKVLTRSDKNRG-KSDN--VP S--EEVVKKMKN-YWRQLLNAKLITQRKFPDNLTKA-ERGGLSE      914

WP_010922251      911 LD  KAGFIKRQLVETRQITKHVAQILDSRMNTKYDENDKLIR--EVKVITLKSKLVSDFRKDF  QFYKVREINNY      981

WP_039695303      921 AD  KAGFIKRQLVETRQITKHVAQILDARFNTEHDENDKVIR--DVKVITLKSNLVSQFRKDF  EFYKVREINDY      991
WP_045635197      913 RD  KVGFIKRQLVETRQITKHVAQILDARYNTEVNEKDKKNR--TVKIITLKSNLVSNERKEF  RLYKVREINDY      983
5AXW_A            633 RD  QKDFINRNLVDTRYATRGLMNLLRSYFR----VNn1DVKVKSINGGFTSFLRRKW      KFKKERNKGYK      702
WP_009880683      595 LD  KAGFIKRQLVETRQITKHVAQILDSRMNTKYDENDKLIR--EVRVITLKSKLVSDERKDF  QFYKVREINNY      665
WP_010922251      911 LD  KAGFIKRQLVETRQITKHVAQILDSRMNTKYDENDKLIR--EVRVITLKSKLVSDERKDF  QFYKVREINNY      981
WP_011054416      911 LD  KVGFIKRQLVETRQITKHVAQILDSRMNTKYDENDKLIR--EVRVITLKSKLVSDERKDF  QFYKVREINNY      981
WP_011284745      911 LD  KAGFIKRQLVETRQITKHVAQILDSRMNTKYDENDKLIR--EVRVITLKSKLVSDERKDF  QFYKVREINNY      981
WP_011285506      911 LD  KAGFIKRQLVETRQITKHVAQILDSRMNTKYDENDKLIR--EVRVITLKSKLVSDERKDF  QFYKVREINNY      981
WP_011277619      911 LD  KAGFIKRQLVETRQITKHVAQILDSRMNTKYDENDKLIR--EVRVITLKSKLVSDERKDF  QFYKVREINNY      981
WP_012560673      911 LD  KAGFIKRQLVETRQITKHVAQILDSRMNTKYDENDKLIR--EVRVITLKSKLVSDERKDF  QFYKVREINNY      981
WP_014407541      910 LD  KAGFIKRQLVETRQITKHVAQILDSRMNTKYDENDKLIR--EVRVITLKSKLVSDERKDF  QFYKVREINNY      980
WP_020905136      911 LD  KAGFIKRQLVETRQITKHVAQILDSRMNTKYDENDKLIR--EVRVITLKSKLVSDERKDF  QFYKVREINNY      981
WP_023080005      910 LD  KAGFIKRQLVETRQITKHVAQILDSRMNTKYDENDKLIR--EVRVITLKSKLVSDERKDF  QFYKVREINNY      980
WP_023610282      910 LD  KAGFIKRQLVETRQITKHVAQILDSRMNTKYDENDKLIR--EVRVITLKSKLVSDERKDF  QFYKVREINNY      980
WP_030125963      910 LD  KAGFIKRQLVETRQITKHVAQILDSRMNTKYDENDKLIR--EVRVITLKSKLVSDERKDF  QFYKVREINNY      980
WP_030126706      911 LD  KAGFIKRQLVETRQITKHVAQILDSRMNTKYDENDKLIR--EVRVITLKSKLVSDERKDF  QFYKVREINNY      981
WP_031488318      911 LD  KAGFIKRQLVETRQITKHVAQILDSRMNTKYDENDKLIR--EVRVITLKSKLVSDERKDF  QFYKVREINNY      981
WP_032461047      911 LD  KAGFIKRQLVETRQITKHVAQILDSRMNTKYDENDKLIR--EVRVITLKSKLVSDERKDF  QFYKVREINNY      981
WP_032462016      911 LD  KAGFIKRQLVETRQITKHVAQILDSRMNTKYDENDKLIR--EVRVITLKSKLVSDERKDF  QFYKVREINNY      981
WP_032462936      911 LD  KAGFIKRQLVETRQITKHVAQILDSRMNTKYDENDKLIR--EVRVITLKSKLVSDERKDF  QFYKVREINNY      981
WP_032464890      911 LD  KAGFIKRQLVETRQITKHVAQILDSRMNTKYDENDKLIR--EVRVITLKSKLVSDERKDF  QFYKVREINNY      981
WP_033888930      736 LD  KAGFIKRQLVETRQITKHVAQILDSRMNTKYDENDKLIR--EVRVITLKSKLVSDERKDF  QFYKVREINNY      806
WP_038431314      911 LD  KAGFIKRQLVETRQITKHVAQILDSRMNTKYDENDKLIR--EVRVITLKSKLVSDERKDF  QFYKVREINNY      981
WP_038432938      910 LD  KAGFIKRQLVETRQITKHVAQILDSRMNTKYDENDKLIR--EVRVITLKSKLVSDERKDF  QFYKVREINNY      980
WP_038434062      911 LD  KAGFIKRQLVETRQITKHVAQILDSRMNTKYDENDKLIR--EVRVITLKSKLVSDERKDF  QFYKVREINNY      981
BAQ51233          822 LD  KAGFIKRQLVETRQITKHVAQILDSRMNTKYDENDKLIR--EVRVITLKSKLVSDERKDF  QFYKVREINNY      892
```

-continued

```
KGE60162          86  KVGFIKRQLVETRQITKHVAQILDSRMNTKYDENDKLIR--EVRVITLKSKLVSDERKDF QFYKVREINNY             156
KGE60856              LD                                                                                    
WP_002989955     911  LD KAGFIKRQLVETRQITKHVAQILDSRMNTKYDENDKLIR--EVRVITLKSKLVSDERKDF QFYKVREINNY             981
WP_003030002     910  ED KAGFIKRQLVETRQITKHVAQILDLDRFNTEFDGNKRRIR--NVKIITLKSNLVSNFRKEF ELYKVREINDY             980
WP_003065552     921  AD KAGFIKRQLVETRQITKHVAQILDARFNTESDENDKVIR--DVKVITLKSNLVSQFRKDF EFYKVREINDY             991
WP_001040076     916  DD KARFIQRQLVETRQITKHVARILDERFNNELDSKGRRIR--KVKIVTLKSNLVSNFRKEF VFYKIREVNDY             986
WP_001040078     916  DD KARFIQRQLVETRQITKHVARILDERFNNELDSKGRRIR--KVKIVTLKSNLVSNFRKEF GFYKIREVNNY             986
WP_001040080     916  DD KARFIQRQLVETRQITKHVARILDERFNNELDSKGRRIR--KVKIVTLKSNLVSNFRKEF GFYKIREVNNY             986
WP_001040081     916  DD KARFIQRQLVETRQITKHVARILDERFNNELDSKGRRIR--KVKIVTLKSNLVSNFRKEF GFYKIREVNNY             986
WP_001040083     916  DD KARFIQRQLVETRQITKHVARILDERFNNELDSKGRRIR--KVKIVTLKSNLVSNFRKEF GFYKIREVNNY             986
WP_001040085     916  DD KARFIQRQLVETRQITKHVARILDERFNNELDSKGRRIR--KVKIVTLKSNLVSNFRKEF GFYKIREVNNY             986
WP_001040087     916  DD KARFIQRQLVETRQITKHVARILDERFNNELDSKGRRIR--KVKIVTLKSNLVSNFRKEF GFYKIREVNNY             986
WP_001040088     916  DD KARFIQRQLVETRQITKHVARILDERFNNELDSKGRRIR--KVKIVTLKSNLVSNFRKEF GFYKIREVNNY             986
WP_001040089     916  DD KARFIQRQLVETRQITKHVARILDERFNNELDSKGRRIR--KVKIVTLKSNLVSNFRKEF GFYKIREVNNY             986
WP_001040090     916  DD KARFIQRQLVETRQITKHVARILDERFNNELDSKGRRIR--KVKIVTLKSNLVSNFRKEF GFYKIREVNNY             986
WP_001040091     916  DD KARFIQRQLVETRQITKHVARILDERFNNELDSKGRRIR--KVKIVTLKSNLVSNFRKEF GFYKIREVNNY             986
WP_001040092     916  DD KARFIQRQLVETRQITKHVARILDERFNNELDSKGRRIR--KVKIVTLKSNLVSNFRKEF GFYKIREVNNY             986
WP_001040094     916  DD KARFIQRQLVETRQITKHVARILDERFNNELDSKGRRIR--KVKIVTLKSNLVSNFRKEF GFYKIREVNNY             986
WP_001040095     916  DD KARFIQRQLVETRQITKHVARILDERFNNELDSKGRRIR--KVKIVTLKSNLVSNFRKEF GFYKIREVNNY             986
WP_001040096     916  DD KARFIQRQLVETRQITKHVARILDERFNNELDSKGRRIR--KVKIVTLKSNLVSNFRKEF GFYKIREVNNY             986
WP_001040097     916  DD KARFIQRQLVETRQITKHVARILDERFNNELDSKGRRIR--KVKIVTLKSNLVSNFRKEF GFYKIREVNNY             986
WP_001040098     916  DD KARFIQRQLVETRQITKHVARILDERFNNELDSKGRRIR--KVKIVTLKSNLVSNFRKEF GFYKIREVNNY             986
WP_001040099     916  DD KARFIQRQLVETRQITKHVARILDERFNNELDSKGRRIR--KVKIVTLKSNLVSNFRKEF GFYKIREVNNY             986
WP_001040100     916  DD KARFIQRQLVETRQITKHVARILDERFNNELDSKGRRIR--KVKIVTLKSNLVSNFRKEF GFYKIREVNNY             986
WP_001040104     916  DD KARFIQRQLVETRQITKHVARILDERFNNELDSKGRRIR--KVKIVTLKSNLVSNFRKEF GFYKIREVNNY             986
WP_001040105     916  DD KARFIQRQLVETRQITKHVARILDERFNNELDSKGRRIR--KVKIVTLKSNLVSNFRKEF GFYKIREVNNY             986
WP_001040106     916  DD KARFIQRQLVETRQITKHVARILDERFNNELDSKGRRIR--KVKIVTLKSNLVSNFRKEF GFYKIREVNNY             986
WP_001040107     916  DD KARFIQRQLVETRQITKHVARILDERFNNELDSKGRRIR--KVKIVTLKSNLVSNFRKEF GFYKIREVNNY             986
WP_001040108     916  DD KARFIQRQLVETRQITKHVARILDERFNNELDSKGRRIR--KVKIVTLKSNLVSNFRKEF GFYKIREVNNY             986
WP_001040109     916  DD KARFIQRQLVETRQITKHVARILDERFNNELDSKGRRIR--KVKIVTLKSNLVSNFRKEF GFYKIREVNNY             986
WP_001040110     916  DD KARFIQRQLVETRQITKHVARILDERFNNKVDDNNKPIR--KVKIVTLKSNLVSNFRKEF GFYKIREVNNY             986
WP_015058523     916  DD KAGFIQRQLVEIRQITKHVARILDERFNNELDSKGRRIR--KVKIVTLKSNLVSNFRKEF GFYKIREVNDY             986
WP_017643650     916  DD KARFIQRQLVETRQITKHVARILDERFNNELDSKGRRIR--KVKIVTLKSNLVSNFRKEF GFYKIREVNNY             986
WP_017647151     916  DD KARFIQRQLVETRQITKHVARILDERFNNELDSKGRRIR--KVKIVTVKSNLVSNFRKEF GFYKIREVNNY             986
WP_017648376     930  DD KARFIQRQLVETRQITKHVARILDELFNNELDSKGRRIR--KVKIVTLKSNLVSNFRKEF GFYKIREVNNY            1000
WP_017649527     916  DD KARFIQRQLVETRQITKHVARILDERFNNELDSKGRRIR--KVKIVTLKSNLVSNFRKEF GFYKIREVNNY             986
WP_017771611     916  DD KARFIQRQLVETRQITKHVARILDERFNNELDSKGRRIR--KVKIVTLKSNLVSNFRKEF GFYKIREVNNY             986
WP_017771984     916  DD KARFIQRQLVETRQITKHVARILDERFNNELDSKGRRIR--KVKIVTLKSNLVSNFRKEF GFYKIREVNNY             986
CFQ25032         916  DD KARFIQRQLVETRQITKHVARILDERFNNELDSKGRRIR--KVKIVTLKSNLVSNFRKEF GFYKIREVNNY             986
CFV16040         916  DD KARFIQRQLVETRQITKHVARILDERFNNELDSKGRRIR--KVKIVTLKSNLVSNFRKEF GFYKIREVNNY             986
KLJ37842         916  DD KARFIQRQLVETRQITKHVARILDERFNNELDSKGRRIR--KVKIVTLKSNLVSNFRKEF GFYKIREVNNY             986
KLJ72361         916  DD KARFIQRQLVETRQITKHVARILDERFNNELDSKGRRIR--KVKIVTLKSNLVSNFRKEF GFYKIREVNNY             986
KLL20707         916  DD KARFIQRQLVETRQITKHVARILDERFNNELDSKGRRIR--KVKIVTLKSNLVSNFRKEF GFYKIREVNNY             986
KLL42645         916  DD KARFIQRQLVETRQITKHVARILDERFNNELDSKGRRIR--KVKIVTLKSNLVSNFRKEF GFYKIREVNNY             986
WP_047207273     916  DD KARFIQRQLVETRQITKHVARILDERFNNELDSKGRRIR--KVKIVTLKSNLVSNFRKEF GFYKIREVNNY             986
WP_047209694     916  DD KARFIQRQLVETRQITKHVARILDERFNNELDSKGRRIR--KVKIVTLKSNLVSNFRKEF GFYKIREVNNY             986
WP_050198062     916  DD KARFIQRQLVETRQITKHVASILDERFNNELDSKGRRIR--KVKIVTLKSNLVSNFRKEF GFYKIREVNNY             986
WP_050201642     916  DD KARFIQRQLVETRQITKHVARILDERFNNELDSKGRRIR--KVKIVTLKSNLVSNFRKEF GFYKIREVNNY             986
WP_050204027     916  DD KARFIQRQLVETRQITKHVARILDERFNNELDSKGRRIR--KVKIVTLKSNLVSNFRKEF GFYKIREVNNY             986
WP_050881965     916  DD KARFIQRQLVETRQITKHVARILDERFNNKVDDNNKPIR--KVKIVTLKSNLVSNFRKEF GFYKIREVNNY             986
WP_050886065     916  DD KARFIQRQLVETRQITKHVARILDERFNNELDSKGRRIR--KVKIVTLKSNLVSNFRKEF GFYKIREVNNY             986
AHN30376         916  DD KARFIQRQLVETRQITKHVARILDERFNNELDSKGRRIR--KVKIVTLKSNLVSNFRKEF GFYKIREVNNY             986
EAO78426         916  DD KAGFIQRQLVETRQITKHVARILDERFNNELDSKGRRIR--KVKIVTLKSNLVSNFRKEF GFYKIREVNNY             986
CCW42055         916  DD KARFIQRQLVETRQITKHVARILDERFNNELDSKGRRIR--KVKIVTLKSNLVSNFRKEF GFYKIREVNDY             986
```

```
WP_003041502  910  ND  KAGFIKRQLVETRQITKHVAQVLDARFNAKHDENKVIR--DVKIITLKSNLVSQFRKDF  KFYKVREINDY  980
WP_037593752  911  ED  KAGFIKRQLVETRQITKHVAQILDERFNTEFDGAQRRIR--NVKIITLKSNLVSNFRKEF  ELYKVREINDY  981
WP_049516684  911  ED  KAGFIKRQLVETRQITKHVAQILDERFNTEFDGAQRRIR--NVKIITLKSNLVSNFRKEF  ELYKVREINDY  981
GAD46167      910  AD  KAGFIKRQLVETRQITKHVAQILDERFNTERDENDKVIR--DVKVITLKSNLVSDFRKEF  ELYKVREINDY  980
WP_018363470  919  AD  KAGFIKRQLVETRQITKHVAQILDSRMNIKRDKNDKPIR--EVKVITLKSKLVSDFRKDF  KFYKVRDINNY  989
WP_003043819  920  ED  KAGFIKRQLVETRQITKHVAQILDERFNTEFDGNKRIR--NVKIITLKSNLVSQFRKEF  QLYKVRDINNY  990
WP_006269658  910  ND  KAGFIHRQLVETRQITKHVAQILDARFNPKRDDNKKVIR--DVKIITLKSKLVSQFRKDF  KLYKVREINNY  980
WP_048800889  910  LD  KAGFIKRQLVETRQITKHVAQILDSRMNIKYDENDKLIR--EVKVITLKSKLVSDFRKDF  QFYKVREINNY  980
WP_012767106  910  LD  KAGFIKRQLVETRQITKHVAQILDSRMNIKYDENDKLIR--EVKVITLKSKLVSDFRKDF  QFYKVREINNY  980
WP_014612333  910  LD  KAGFIKRQLVETRQITKHVAQILDSRMNIKYDENDKLIR--EVKVITLKSKLVSDFRKDF  QFYKVREINNY  980
WP_015017095  910  LD  KAGFIKRQLVETRQITKHVAQILDSRMNIKYDENDKLIR--EVKVITLKSKLVSDFRKDF  QFYKVREINNY  980
WP_015057649  910  LD  KAGFIKRQLVETRQITKHVAQILDSRMNIKYDENDKLIR--EVKVITLKSKLVSDFRKDF  QFYKVREINNY  980
WP_048327215  910  LD  KAGFIKRQLVETRQITKHVAQILDSRMNIKYDENDKLIR--EVKVITLKSKLVSDFRKDF  QFYKVREINNY  980
WP_049519324  910  LD  KAGFIKRQLVETRQITKHVAQILDSRMNIKYDENDKLIR--EVKVITLKSKLVSDFRKDF  QFYKVREINNY  980
WP_012515931  910  VD  KAGFIQRQLVETRQITKHVAQILDSRFNTEFDDHNKRIR--KVHIITLKSKLVSDFRKEF  GLYKIRDINHY  980
WP_021320964  910  VD  KAGFIQRQLVETRQITKHVAQILDSRFNTEFDDHNKRIR--KVHIITLKSKLVSDFRKEF  GLYKIRDINHY  980
WP_037581760  910  VD  KAGFIKRQLVETRQITKHVAQILDSRFNTEFDDHNKRIR--KVHIITLKSKLVSDFRKEF  GLYKIRDINHY  980
WP_004232481  918  TD  KAGFIKRQLVETRQITKHVAQILDSRFNTKCDENDKVIR--DVKVITLKSSLVSDFRKDF  KFYKVREINDY  988
WP_009854540  919  AD  KAGFIKRQLVETRQITKHVAQILDSRFNTEHDENDKVIR--DVKVITLKSNLVSQFRKEF  EFYKVREINDY  989
WP_012962174  910  ND  KAGFIKRQLVETRQITKHVAQILDSRFNTERDENDKVIR--NVKVITLKSNLVSQFRKEF  KFYKVREINDY  980
WP_039695303  921  AD  KAGFIKRQLVETRQITKHVAQILDSRFNSNLTEDSKSNR--DVKVITLKSNLVSQFRKDF  KFYKVREINDY  991
WP_014334983  918  AD  KAGFIKRQLVETRQITKHVAQILDSRFNSNLTEDSKSNR--NVKIITLKSKMVSDFRKDF  GFYKLREVNDY  988
WP_003092269  911  FD  KAGFIKRQLVETRQITKHVAQILDSRFNSNLTEDSKSNR--NVKIITLKSKMVSDFRKDF  GFYKLREVNDY  981
AHY15608      911  FD  KAGFIKRQLVETRQITKHVAQILDSRFNSNLTEDSKSNR--NVKIITLKSKSNR------  ------------  981
AHY17476      911  --  ----------------------------------------------------------  ------------  981
ESR09100      911  FD  KAGFIKRQLVETRQITKHVAQILDSRFNSNLTEDSKSNR--NVKIITLKSKSNR  GFYKLREVNDY  981
AGM98575      911  DD  KAGFIKRQLVETRQITKHVAQILDSRFNTETDENNKIR--NVKIITLKSNLVSNFRKEF  ELYKVREINDY  981
ALF27331      924  ED  KAGFIRRQLVETRQITKHVARLLDEKLNRKKNENGEKLR--TTKIITLKSVFASRFRANF  DLYKLRELNHY  994
WP_018372492  914  RD  KVGFIKRQLVETRQITKHVAQILDARFNTEVTEKDKKDR--SVKIITLKSNLVSDFRKDF  RLYKVREINDY  984
WP_045618028  913  RD  KVGFIKRQLVETRQITKHVAQILDARYNIEVNEKDKKNR--TVKIITLKSNLVSNFRKEF  RLYKVREINDY  983
WP_045635197  913  DD  KAGFIKRQLVETRQITKHVARIILDERFNTETDENNKKIR--QVKVITLKSNLVSNFRKEF  ELYKVREINDY  983
WP_002263549  911  DD  KAGFIKRQLVETRQITKHVARIILDERFNTETDENNKKIR--QVKIVTLKSNLVSNFRKEF  ELYKVREINDY  981
WP_002263887  911  DD  KAGFIKRQLVETRQITKHVARIILDERFNTETDENNKKIR--QVKIVTLKSNLVSNFRKEF  ELYKVREINDY  981
WP_002264920  911  DD  KAGFIKRQLVETRQITKHVARIILDERFNTETDENNKKIR--QVKIVTLKSNLVSNFRKEF  ELYKVREINDY  981
WP_002269943  911  DD  KAGFIKRQLVETRQITKHVARIILDERFYTETDENNKKIR--QVKIVTLKSNLVSNFRKEF  ELYKVREINDY  981
WP_002269448  911  DD  KAGFIKRQLVETRQITKHVARIILDERFNTETDENNKKIR--QVKIVTLKSNLVSNFRKEF  ELYKVREINDY  981
WP_002271977  911  DD  KAGFIKRQLVETRQITKHVARIILDERFYTETDENNKKIR--QVKIVTLKSNLVSNFRKEF  ELYKVREINDY  981
WP_002272766  911  DD  KAGFIKRQLVETRQITKHVARIILDERFNTETDENNKKIR--QVKIVTLKSNLVSNFRKEF  ELYKVREINDY  981
WP_002273241  911  DD  KAGFIKRQLVETRQITKHVARIILDERFHTETDENNKIR--QVKIVTLKSNLVSNFRKEF  ELYKVREINDY  981
WP_002275430  911  DD  KAGFIKRQLVETRQITKHVARIILDERFNTETDENNKKIR--QVKIVTLKSNLVSSFRKEF  ELYKVREINDY  981
WP_002276448  911  DD  KAGFIKRQLVETRQITKHVARIILDERFHTETDENNKKIR--QVKIVTLKSNLVSNFRKEF  ELYKVREINDY  981
WP_002277050  911  DD  KAGFIKRQLVETRQITKHVARIILDERFNTETDENNKKIR--QVKIVTLKSNLVSNFRKEF  ELYKVREINDY  981
WP_002773364  913  DD  KAGFIKRQLVETRQITKHVARIILDERFYTETDENNKKIR--RVKIVTLKSNLVSNFRKEF  ELYKVREINDY  983
WP_002779025  911  DD  KAGFIKRQLVETRQITKHVARIILDERFNTETDENNKKIR--QVKIVTLKSNLVSNFRKEF  ELYKVREINDY  981
WP_002779859  911  DD  KAGFIKRQLVETRQITKHVARIILDERFNTETDENNKKIR--QVKIVTLKSNLVSSFRKEF  ELYKVREINDY  981
WP_002280230  913  DD  KAGFIKRQLVETRQITKHVARMLDERFNKEFDDNNKKIR--RVKIVTLKSNLVSNFRKEF  ELYKVREINDY  983
WP_002281696  911  DD  KAGFIKRQLVETRQITKHVARIILDERFHTETDENNKKIR--QVKIVTLKSNLVSNFRKEF  ELYKVREINDY  981
WP_002282247  913  DD  KAGFIKRQLVETRQITKHVARMLDERFNKEFDDNNKKIR--RVKIVTLKSNLVSNFRKEF  ELYKVREINDY  983
WP_002282906  911  DD  KAGFIKRQLVETRQITKHVARIILDERFNTETDENNKKIR--QVKIVTLKSNLVSNFRKEF  ELYKVREINDY  981
WP_002283846  911  DD  KAGFIKRQLVETRQITKHVARIILDERFHTETDENNKKIR--QVKIVTLKSNLVSNFRKEF  ELYKVREINDY  981
WP_002287255  911  DD  KAGFIKRQLVETRQITKHVARIILDERFNTETDENNKKIR--QVKIVTLKSNLVSNFRKEF  ELYKVREINDY  981
WP_002288990  911  DD  KAGFIKRQLVETRQITKHVARIILDERFNTETDENNKKIR--QVKIVTLKSNLVSNFRKEF  ELYKVREINDY  981
WP_002289641  911  DD  KAGFIKRQLVETRQITKHVARIILDERFNTETDENNKKIR--QVKIVTLKSNLVSNFRKEF  ELYKVREINDY  981
WP_002290427  911  DD  KAGFIKRQLVETRQITKHVARIILDERFNTETDENNKKIR--QVKIVTLKSNLVSNFRKEF  ELYKVREINDY  981
```

-continued

```
WP_002295753    911  DD KAGFIKRQLVETRQITKHVARILDERFYTEDENNKKIR--QVKIVTLKSNLVSNFRKEF ELYKVREINDY  981
WP_002296423    911  DD KAGFIKRQLVETRQITKHVARILDERFYTEDENNKKIR--QVKIVTLKSNLVSNFRKEF ELYKVREINDY  981
WP_002304487    925  DD KAGFIKRQLVETRQITKHVARILDERFNTETDENNKKIR--QVKIVTLKSNLVSNFRKEF ELYKVREINDY  995
WP_002305844    911  DD KAGFIKRQLVETRQITKHVARILDERFNTETDENNKKIR--QVKIVTLKSNLVSNFRKEF ELYKVREINDY  981
WP_002307203    911  DD KAGFIKRQLVETRQITKHVARILDERFNTETDENNKKIR--QVKIVTLKSNLVSNFRKEF ELYKVREINDY  981
WP_002310390    911  DD KAGFIKRQLVETRQITKHVARILDERFNTETDENNKKIR--QVKIVTLKSNLVSNFRKEF ELYKVREINDY  981
WP_002352408    911  DD KAGFIKRQLVETRQITKHVARILDERFNTETDENNKKIR--QVKIVTLKSNLVSNFRKEF ELYKVREINDY  981
WP_012997688    911  DD KAGFIKHQLVETRQITKHVARILDERFNTETDENNKKIR--QVKIVTLKSNLVSNFRKEF ELYKVREINDY  981
WP_014677909    911  DD KAGFIKRQLVETRQITKHVARILDERFYTETDENNKKIR--QVKIVTLKSNLVSNFRKEF ELYKVREINDY  981
WP_019312892    911  DD KAGFIKRQLVETRQITKHVARILDERFHTETDENNKKIR--QVKIVTLKSNLVSNFRKEF ELYKVREINDY  981
WP_019313659    911  DD KAGFIKRQLVETRQITKHVARILDERFHTETDENNKKIR--QVKIVTLKSNLVSNFRKEF ELYKVREINDY  981
WP_019314093    911  DD KAGFIKRQLVETRQITKHVARILDERFNTETDENNKKIR--QVKIVTLKSNLVSNFRKEF ELYKVREINDY  981
WP_019315370    911  DD KAGFIKRQLVETRQITKHVARILDERFNTETDENNKKIR--QVKIVTLKSNLVSNFRKEF ELYKVREINDY  981
WP_019803776    911  DD KAGFIKRQLVETRQITKHVARILDERFNTETDENNKKIR--QVKIVTLKSNLVSNFRKEF ELYKVREINDY  981
WP_019805234    911  DD KAGFIKRQLVETRQITKHVARILDERFNTETDENNKKIR--QVKIVTLKSNLVSNFRKEF ELYKVREINDY  981
WP_024783594    911  DD KAGFIKRQLVETRQITKHVARILDERFNTETDENNKKIR--QVKIVTLKSNLVSNFRKEF ELYKVREINDY  981
WP_024784288    913  DD KAGFIKRQLVETRQITKHVARMLDERFNKEFDDNNKKIR--RVKIVTLKSNLVSSFRKEF ELYKVREINDY  983
WP_024784666    911  DD KAGFIKRQLVETRQITKHVARILDERFHTETDENNKKIR--QVKIVTLKSNLVSNFRKEF ELYKVREINDY  981
WP_024784894    911  DD KAGFIKRQLVETRQITKHVARILDERFNTETDENNKKIR--QVKIVTLKSNLVSNFRKEF ELYKVREINDY  981
WP_024786433    913  DD KAGFIKRQLVETRQITKHVARMLDERFNKEFDDNNKFIR--RVKIVTLKSNLVSSFRKEF ELYKVREINDY  983
WP_049473442    913  DD KAGFIKRQLVETRQITKHVARILDERFNTETDENNKKIR--QVKIVTLKSKIVSDFRKDF ELYKVREINDY  983
WP_049474547    911  DD KAGFIKRQLVETRQITKHVARILDERFNTETDENNKKIR--QVKIVTLKSNLVSNFRKEF ELYKVREINDY  981
EMC03581        904  DD KVGFIKRQLVETRQITKHVAQILDARYNTEVNEKDKKNR--TVKIITLKSNLVSNFRKEF RLYKVREINDY  974
WP_000428612    916  RD KVGFIKRQLVETRQITKHVAQILDARFNKVNEEKDKKNR--TVKIITLKSNLVSNFRKEF RLYKIREINDY  986
WP_000428613    914  RD KVGFIKRQLVETRQITKHVAQILDARENTEVNEKDKKNR--TVKIITLKSNLVSNFRKEF RLYKVREINDY  984
WP_049523028    909  RD KVGFIKRQLVETRQITKHVAQILDDRFNAEVNEKNQKLR--SVKIITLKSNLVSNFRKEF GLYKVREINDY  979
WP_003107102    880  YD KAGFIKRQLVETRQITKHVAQILLNNRFNNNVDDSSKNKR--PVKIITLKSKMVSDFRKEF GFYKIREVNDY  950
WP_054279288    912  SD KANFIKRQLVETRQITKHVAQIDLSRFNTERDEKDRPIR--RVKVITLKSKFVSDFRQDF GFYKLREVNDY  982
WP_049531101    914  RD KVGFIKRQLVETRQITKHVAQILDSRENTVNEKNQKIR--TVKIITLKSNLVSNFRKEF RLYKVREINDY  984
WP_049538452    916  LD KVGFIRRQLVETRQITKHVAQIDRENTEVTEKDKKNR--NVKIITLKSNLVSNFRKEF RLYKVREINDY  986
WP_049549711    917  SD KVGFIRRQLVETRQITKHVAQIDARFNKEVTEKDKKNR--NVKIITLKSNLVSNFRKEF RLYKVREINDY  987
WP_007896501    869  SD KARFIRRQLVETRQITKHVAQLLDSRENSKSNQNKKLAR--NVKIITLKSKIVSDFRKDF GLYKLREVNNY  939
EFR44625        913  SD KARFIRRQLVETRQITKHVAQLLDSRENSKSNQNKKLAR--NVKIITLKSNLVSNFRKEF GLYKLREVNNY  983
WP_002897477    913  RD KVGFIRRQLVETQQITKHVAQIDARENTEVKEKNQKIR--TVKIITLKSNLVSNFRKEF GLYKVREINNY  983
WP_002906454    913  RD KVGFIKRQLVETRQITKHVAQLLDTRENTEVNEENQKIR--TVKIITLKSNLVSNFRKEF ELYKVREINDY  983
WP_009729476    918  LD KAGFIKRQLVETRQITKHVAQILDARFNRDFDKNDKIR--TVKIITLKSNLVSNFRKEF GFYKREINNF  988
CQR24647        914  ED KAGFIKRQLVETRQITKHVAQILDARFNRDFDKNDKLIR--EVKVITLKSNLVSNFRKEF GLYKVREINNY  984
WP_000066813    913  RD KVGFIKRQLVETRQITKHVAQFLDARFNKEVTEKDKKNR--SVKIITLKSNLVSNFRKEF KLYKVREINDY  985
WP_009754323    914  ED KVGFIKRQLVETRQITKHVARILDARENTEVSEKNQKIR--SVKIITLKSNLVSNFRKEF QLYKVREINNY  985
WP_044674937    913  ED KARFIKRQLVETRQITKHVARILDTRENTKLDEAGNRIRdpKVNIITLKSNLVSQFRKDY QLYKVREINNY  985
WP_044676715    915  ED KARFIQRQLVETRQITKHVARILDTRENTKLDEAGNRIRdpKVNIITLKSNLVSQFRKDY QLYKVREINNY  987
WP_044680361    913  ED KARFIQRQLVETRQITKHVARILDTRENTKLDEAGNRIRdpKVNIITLKSNLVSQFRKDY QLYKVREINNY  985
WP_044681799    910  ED KARFIQRQLVETRQITKHVAVLDARFNAKHDENKKVIR--dTTKVFAIKATLVSGLRRKF EFIKNRNVNDY  980
WP_049533112    917  ND KEGFIARQLVETRQITKHVTQLLQQEY--------------K-dTTKVFAIKATLVSGLRRKF EFIKNRNVNDY  951
WP_029090905    891  RD EERFINRQLVETRQITKHVTQLLQQEY--------------------- HIYKNRDINDY  976
WP_006506696    917  LD RQQFINRQLVETRQITKHVAQILDSRMNTKYDENDKLIR--EVNVLLKSALTSQRERKDF QFYKVREINNY  981
AIT42264        911  RD KAGFIKRQLVETRQITKHVAQILDSRMNTKYDENDKLIR--EVKVITLKSKLVSDERKDF DFYKVREVNDY  980
AKQ21048        915  LD RAHFLNRQLVETRQITKHVANLLDSQYNTAEEQ------R--INIVLLKSSMTSRFRKEF KLYKVREINNF  981
WP_004636532    916  AD KAHFIQRQLVETRQITKHVAGILDQRYNANSKE----K--KVQIITLKASLTSQFRSIF GLYKVREVNDY  980
WP_002364836    922  ED KAHFIQRQLVETRQITKHVAGILDQRYNAKSKE----K--KVQIITLKASLTSQFRSIF GLYKVREVNDY  987
WP_016631044    873  ED KAHFIQRQLVETRQITKHVAAILDQYFN-QPEE-SK-NK--GIRIITLKSSLVSQFRKTF GINKVREINNH  938
EMS75795        655  ED                                                                         722
WP_002373311    922  ED KAHFIQRQLVETRQITKHVAGILDQRYNAKSKE----K--KVQIITLKASLTSQFRSIF GLYKVREVNDY  987
```

```
                                                          -continued
WP_002378009   922  KAHFIQRQLVETRQITKNVAGILDQRYNAKSKE------K--KVQIITLKASLTSQFRSIF  GLYKVREVNDY  987
WP_002407324   922  KAHFIQRQLVETRQITKNVAGILDQRYNAKSKE------K--KVQIITLKASLTSQFRSIF  GLYKVREVNDY  987
WP_002413717   922  KAHFIQRQLVETRQITKNVAGILDQRYNANSKE------K--KVQIITLKASLTSQFRSIF  GLYKVREVNDY  987
WP_010775580   924  KAHFIQRQLVETRQITKNVAGILDQRYNANSKE------K--KVQIITLKASLTSQFRSIF  GLYKVREVNDY  989
WP_010818269   922  KAHFIQRQLVETRQITKNVAGILDQLYNAKSKE------K--KVQIITLKASLTSQFRSIF  GLYKVREVNDY  987
WP_010824395   922  KAHFIQRQLVETRQITKNVAGILDQLYNAKSKE------K--KVQIITLKASLTSQFRSIF  GLYKVREVNDY  987
WP_016622645   922  KAHFIQRQLVETRQITKNVAGILDQRYNAKSKE------K--KVQIITLKASLTSQFRSIF  GLYKVREVNDY  987
WP_033624816   922  KAHFIQRQLVETRQITKNVAGILDQRYNAKSKE------K--KVQIITLKASLTSQFRSIF  GLYKVREVNDY  987
WP_033625576   922  KAHFIQRQLVETRQITKNVAGILDQRYNAKSKE------K--KVQIITLKASLTSQFRSIF  GLYKVREVNDY  987
WP_033789179   922  KAHFIQRQLVETRQITKNVAGILDQRYNAKSKE------K--KVQIITLKSALVSQFRNRF  GLYKVREVNDY  987
WP_002310644   919  KAGFIKRQLVETRQITKHVAGILHHRFN-KAEDTNEPIR--KVRIITLKSALVSQFRNRF   GIYKVREINEY  988
WP_002312694   920  KAGFIKRQLVETRQITKHVAGILHHRFN-KAEDTNDPIR--KVRIITLKSALVSQFRNRF   GIYKVREINEY  989
WP_002314015   920  KAGFIKRQLVETRQITKHVAGILHHRFN-KAEDTNEPIR--KVRIITLKSALVSQFRNRF   GIYKVREINEY  989
WP_002220716   920  KAGFIKRQLVETRQITKHVAGILHHRFN-KAEDTNEPIR--KVRIITLKSALVSQFRNRF   GIYKVREINEY  989
WP_002330729   919  KAGFIKRQLVETRQITKHVAGILHHRFN-KAEDTNEPIR--KVRIITLKSALVSQFRNRF   GIYKVREINEY  988
WP_002335161   920  KAGFIKRQLVETRQITKHVAGILHHRFN-KAEDTNEPIR--KVRIITLKSALVSQFRNRF   GIYKVREINEY  989
WP_002345439   920  KAGFIKRQLVETRQITKHVAGILHHRFN-KAEDTNEPIR--KVRIITLKSALVSQFRNRF   GIYKVREINEY  989
WP_034867970   911  KARFIQRQLVETRQITKHVANILHQSFN-QEEEGTD-CD--GVQIITLKATLTSQFRQTF   GLYKVREINPH  979
WP_047937432   920  KAGFIKRQLVETRQITKHVANILHHRFN-KAEDTNEPIR--KVRIITLKSALVSQFRNRF   GIYKVREINEY  989
WP_010720994   911  KARFIQRQLVETRQITKHVANILHQSFN-QEEEGTD-CD--GVQIITLKATLTSQFRQTF   GLYKVREINPH  979
WP_010737004   911  KARFIQRQLVETRQITKHVANILHQSFN-QEEEGTD-CD--GVQIITLKATLTSQFRQTF   GLYKVREINPH  979
WP_034700478   911  KARFIQRQLVETRQITKHVANILHQSFN-QEEEGTD-CD--GVQIITLKATLTSQFRQTF   GLYKVREINPH  979
WP_007209003   912  KAGELKRQLVETRQITKHVATILDSKFNE--DSNNRDVQ------IITLKSALVSEFRKTF  NLYKVREINDL  977
WP_023519017   905  KARFIKRQLVETRQITKHVANLLHQHFN-LPEEVSA-TE--KTSIITLKSTLTSQFROMF   DIYKVREINHH  973
WP_010770040   915  RAHFIKRQLVETRQITKHVARILDQRFNSQKDEEGKTIR--AVRVVTLKSSLTSQFRKQF   AIHKVREINDY  985
WP_048604708   912  KAGFIKRQLVETRQITKNVARILHQRFNMSEKDEEGNLIR--KVRIITLKSALTSQFRKNY  GIYKIREINDY  982
WP_010750235   912  KAGFIKRQLVETRQITKNVARILHQYFN-QTQELEK-EK--DIRIITLKSSLVSQFRQVF   QFYKVREINHH  982
AII16583       950  KAGFIKRQLVETRQITKHVAQILDSRMNTKYDENDKLIR--EVKVITLKSALVSQFRKQF   QFYKVREINNY  1020
WP_029073316   928  KERFINRQIVETRQITKHVAQIISNHYET----------TKVVTVRADLSHAFRERY    HIYKNRDINDF  987
WP_031589969   928  QERFINRQLVETRQITKYVAQLLDQRLN--YDGNGVELD--eKIAIVTLKQALASQFRSEF  HIYKNRDINDF  987
KDA45870       903  KERFIERQLVETRQITKVQIKLATNLLMEQYGED------NIELITVKSGLTHQMRTEF   KLRKVRALNNL  972
WP_039099354   924  MKGFIKRQLVQTSQMVGVANILNSMYK---NQGTTCIQ----ARANLSTAFRKAL       DFPKNRNLANH  990
AKP02966       926  KLGFIHRQLVQTSQMVGVANILNSMYK---NQGTTCIQ----ARANLSTAFRKAL       ELVKNRNINDF  999
WP_010991369   914  KARFIHRQLVETRQITKNVANILHQRFNYEKDDHGNTMK---QVRIVTLKSALVSQFRKQF  QLYKVRDVNDY  984
WP_033838504   914  KARFIHRQLVETRQITKNVANILHQRFNYEKDDHGNTMK---QVRIVTLKSALVSQFRKQF  QLYKVRDVNDY  984
EHN60060       917  KARFIHRQLVETRQITKNVANILHQRFNYEKDDHGNTMK---QVRIVTLKSALVSQFRKQF  QLYKVRDVNDY  987
EFR89594       683  KARFIHRQLVETRQITKNVANILHQRFNYGKDDHGNTMK---QVRIVTLKSALVSQFRKQF  QLYKVRGVNDY  753
WP_038409211   914  KANFIQRQLVETRQITKNVANILYQRFNCKQDENGNEVE---QVRIVTLKSTLVSQFRKQF  QLYKVREVNDY  984
EFR95520       533  KANFIQRQLVETRQITKNVANILYQRFNCKQDENGNEVE---QVRIVTLKSTLVSQFRKQF  QLYKVREVNDY  603
WP_003723650   914  KARFIHRQLVETRQITKNVANILHQRFNKETDNHGNTME---QVRIVTLKSALVSQFRKQF  QLYKVREVNGY  984
WP_003727705   914  KARFIHRQLVETRQITKNVANILHQRFNKETDNHGNTME---QVRIVTLKSALVSQFRKQF  QLYKVREVNDY  984
WP_003730785   914  KARFIHRQLVETRQITKNVANILHQRFNKETDNHGNTME---QVRIVTLKSALVSQFRKQF  QLYKVREVNDY  984
WP_003733029   914  KARFIHRQLVETRQITKNVANILHQRFNKETDNHGNTME---TVRIVTLKSALVSQFRKQF  QFYKVREVNDY  984
WP_003739838   914  KATFIHRQLVETRQITKNVANILHQRFNYKTDGNKDTME---QVRIVMLKSALVSQFRKQF  QLYKVREVNDY  984
WP_014601172   914  KARFIHRQLVETRQITKNVANILHQRFNYKTDGNNDTME---QVRIVTLKSALVSQFRKQF  QLYKVREVNDY  984
WP_023548323   914  KARFIHRQLVETRQITKNVANILHQRFNYKTDDNEDTME---TVRIVTLKSALVSQFRKQF  QFYKVREVNDY  984
WP_031665337   914  KARFIHRQLVETRQITKNVANILHQRFNYKTDGNKDTME---PVRIVTLKSALVSQFRKQF  QLYKVREVNDY  984
WP_031669209   914  KARFIHRQLVETRQITKNVANILHQRFNKETDNHGNTME---PVRIVTLKSALVSQFRKQF  QLYKVREVNDY  984
WP_023920898   917  KARFIHRQLVETRQITKNVANILHQRFNETDNHGNTME----QVRIVTLKSALVSQFRKQF  QLYKVREVNDY  987
AKI42028       917  KARFIHRQLVETRQITKNVANILHQRFNNETDNHGNTME---QVRIVTLKSALVSQFRKQF  QLYKVREVNDY  987
AKI50529       362  KARFIHRQLVETRQITKNVANILHQRFNCKKDESGNVIE---QVRIVTLKAALVSQFRKQF  QLYKVREVNDY  432
EFR83390       914  KARFIHRQLVETRQITKNVANILHQRFNNETDNHGNTME---QVRIVTLKSALVSQFRKQF  QLYKVREVNDY  984
WP_046323366   914  KAGFIKRQLVETRQITKNVANILDSRMNTKYDENDKLIR---EVKVITLKSKLVSDERKDF  QFYKVREINNY  997
AKE81011       927  KAGFIKRQLVETRQITKNVANILDSRMNTKYDENDKLIR---EVKVITLKSKLVSDERKDF  QFYKVREINNY  997
```

-continued

```
CUO82355         921  RD    EERFINRQLVETRQITKNVTQIIEDHYST------------TKVAAIRANLSHEFRVKN  HIYKNRDINDY  980
WP_033162887     923  KD    KERFINRQLVETRQIIKNVAVIINDHYTN------------TNIVTVRAELSHQFRERY  KIYKNRDINDF  982
AGZ01981         944  LD    KAGFIKRQLVETRQITKHVAQILDSRMNTKYDENDKLIR--EVKVITLKSKLVSDFRKDF  QFYKVREINNY  1014
AKA60242         911  LD    KAGFIKRQLVETRQITKHVAQILDSRMNTKYDENDKLIR--EVKVITLKSKLVSDFRKDF  QFYKVREINNY  981
AKS40380         911  LD    KAGFIKRQLVETRQITKHVAQILDSRMNTKYDENDKLIR--EVKVITLKSKLVSDFRKDF  QFYKVREINNY  981
4UN5_B           915  LD    KAGFIKRQLVETRQITKHVAQILDSRMNTKYDENDKLIR--EVKVITLKSKLVSDFRKDF  QFYKVREINNY  985

WP_010922251     982  HHAHDAYLNAVVGTALIKKYPKL-ESEFVYGDYKVYDV    S--EQEi--GK    ATAKY--F-FYSNIM-NFFKTEIT  1051

WP_039695303     992  HHAHDAYLNAVVGTALIKKYPKL-ASEFVYGEYKKYDI    S---SD----    KATAKY--YfFYSNLM-NFFKTKVK  1058
WP_045635197     984  HHAHDAYLNAVVAKAILKKYPKL-EPEPFVYGEYQKYDL   SkdpKEV----   ATEKY--F-FYSNLL-NFFKEEVH  1055
5AXW_A           703  HHAEDALI-------------iaNADFIFKEWKKLDK     Nq-mFE----    ETEQEyKEiFITPHQiKHIKDFKD  771
WP_009880683     666  HHAHDAYLNAVVGTALIKKYPKL-ESEFVYGDYKVYDI    S---EQEi--GK    ATAKY--F-FYSNIM-NFFKTEIT  735
WP_010922251     982  HHAHDAYLNAVVGTALIKKYPKL-ESEFVYGDYKVYDV    S---EQEi--GK    ATAKY--F-FYSNIM-NFFKTEIT  1051
WP_011054416     982  HHAHDAYLNAVVGTALIKKYPKL-ESEFVYGDYKVYDV    S---EQEi--GK    ATAKY--F-FYSNIM-NFFKTEIT  1051
WP_011284745     982  HHAHDAYLNAVVGTALIKKYPKL-ESEFVYGDYKVYDV    S---EQEi--GK    ATAKY--F-FYSNIM-NFFKTEIT  1051
WP_011285506     982  HHAHDAYLNAVVGTALIKKYPKL-ESEFVYGDYKVYDV    S---EQEi--GK    ATAKY--F-FYSNIM-NFFKTEIT  1051
WP_011527619     982  HHAHDAYLNAVVGTALIKKYPKL-ESEFVYGDYKVYDI    S---EQEi--GK    ATAKY--F-FYSNIM-NFFKTEIT  1051
WP_012560673     982  HHAHDAYLNAVVGTALIKKYPKL-ESEFVYGDYKVYDV    S---EQEi--GK    ATAKY--F-FYSNIM-NFFKTEIT  1051
WP_014407541     981  HHAHDAYLNAVVGTALIKKYPKL-ESEFVYGDYKVYDV    S---EQEi--GK    ATAKY--F-FYSNIM-NFFKTEIT  1050
WP_020905136     981  HHAHDAYLNAVVGTALIKKYPKL-ESEFVYGDYKVYDV    S---EQEi--GK    ATAKY--F-FYSNIM-NFFKTEIT  1050
WP_023080005     982  HHAHDAYLNAVVGTALIKKYPKL-ESEFVYGDYKVYDV    S---EQEi--GK    ATAKY--F-FYSNIM-NFFKTEIT  1051
WP_023610282     982  HHAHDAYLNAVVGTALIKKYPKL-ESEFVYGDYKVYDV    S---EQEi--GK    ATAKY--F-FYSNIM-NFFKTEIT  1051
WP_023612936     982  HHAHDAYLNAVVGTALIKKYPKL-ESEFVYGDYKVYDV    S---EQEi--GK    ATAKY--F-FYSNIM-NFFKTEIT  1051
WP_030125963     982  HHAHDAYLNAVVGTALIKKYPKL-ESEFVYGDYKVYDV    S---EQEi--GK    ATAKY--F-FYSNIM-NFFKTEIT  1051
WP_030126706     982  HHAHDAYLNAVVGTALIKKYPKL-ESEFVYGDYKVYDV    S---EQEi--GK    ATAKY--F-FYSNIM-NFFKTEIT  1051
WP_031488318     982  HHAHDAYLNAVVGTALIKKYPKL-ESEFVYGDYKVYDV    S---EQEi--GK    ATAKY--F-FYSNIM-NFFKTEIT  1051
WP_032460140     982  HHAHDAYLNAVVGTALIKKYPKL-ESEFVYGDYKVYDV    S---EQEi--GK    ATAKY--F-FYSNIM-NFFKTEIT  1051
WP_032461047     982  HHAHDAYLNAVVGTALIKKYPKL-ESEFVYGDYKVYDI    S---EQEi--GK    ATAKY--F-FYSNIM-NFFKTEIT  1051
WP_032462016     982  HHAHDAYLNAVVGTALIKKYPKL-ESEFVYGDYKVYDV    S---EQEi--GK    ATAKY--F-FYSNIM-NFFKTEIT  1051
WP_032462936     982  HHAHDAYLNAVVGTALIKKYPKL-ESEFVYGDYKVYDV    S---EQEi--GK    ATAKY--F-FYSNIM-NFFKTEIT  1051
WP_032464890     982  HHAHDAYLNAVVGTALIKKYPKL-ESEFVYGDYKVYDV    S---EQEi--sRK   ATAKY--F-FYSNIM-NFFKTEIT  1051
WP_033888930     807  HHAHDAYLNAVVGTALIKKYPKL-ESEFVYGDYKVYDV    S---EQEi--GK    ATAKY--F-FYSNIM-NFFKTEIT  876
WP_038431314     982  HHAHDAYLNAVVGTALIKKYPKL-ESEFVYGDYKVYDV    S---EQEi--GK    ATAKY--F-FYSNIM-NFFKTEIT  1051
WP_038432938     981  HHAHDAYLNAVVGTALIKKYPKL-ESEFVYGDYKVYDV    S---EQEi--GK    ATAKY--F-FYSNIM-NFFKTEIT  1050
WP_038434062     982  HHAHDAYLNAVVGTALIKKYPKL-ESEFVYGDYKVYDV    S---EQEi--GK    ATAKY--F-FYSNIM-NFFKTEIT  1051
BAQ51233         893  HHAHDAYLNAVVGTALIKKYPKL-ESEFVYGDYKVYDV    S---EQEi--GK    ATAKY--F-FYSNIM-NFFKTEIT  962
KGE60162         157  ---------------------------------------   -----------    ----------------------  226
KGE60856         982  HHAHDAYLNAVVGTALIKKYPKL-ESEFVYGDYKVYDV    S---EQEi--GK    ATAKY--F-FYSNIM-NFFKTEIT  1051
WP_002989955     981  HHAHDAYLNAVVGNALLLKYPKL-ASEFVYGEYPKYDA    S---YR----sRK   SATEK--FlFYSNIL-RPFKKE-  1041
WP_003030002     992  HHAHDAYLNAVVAKAILTKYPQL-EPEFVYGDYKVYDI    S---SD----    KATAK--YfFYSNLM-NFFKRVIR  1058
WP_003065552     992  HHAHDAYLNAVVAKAILTKYPQL-EPEFVYGDYKVYDI    S---YKT---RK    ATEKL--F-FYSNIM-NFFKRVT  1058
WP_001040076     987  HHAHDAYLNAVVAKAILTKYPQL-EPEFVYGDYPKYN     S---YKT---RK    ATRKM--F-FYSNLM-NMFKRVVR  1057
WP_001040078     987  HHAHDAYLNAVVAKAILTKYPQL-EPEFVYGDYPKYN     L---SKI---VR    ATEKL--F-FYSNIM-NFFKTKVT  1049
WP_001040080     987  HHAHDAYLNAVVAKAILTKYPQL-EPEFVYGDYPKYN     S---YKT---RK    ATEKL--F-FYSNIM-NFFKTKVT  1049
WP_001040081     987  HHAHDAYLNAVVAKAILTKYPQL-EPEFVYGDYPKYN     S---YKT---RK    ATEKL--F-FYSNIM-NFFKTKVT  1049
WP_001040083     987  HHAHDAYLNAVVAKAILTKYPQL-EPEFVYGDYPKYN     S---YKT---RK    ATEKL--F-FYSNIM-NFFKTKVT  1049
WP_001040085     987  HHAHDAYLNAVVAKAILTKYPQL-EPEFVYGDYPKYN     S---YKT---RK    ATEKL--F-FYSNIM-NFFKTKVT  1049
WP_001040087     987  HHAHDAYLNAVVAKAILTKYPQL-EPEFVYGDYPKYN     S---YKT---RK    ATEKL--F-FYSNIM-NFFKTKVT  1049
WP_001040088     987  HHAHDAYLNAVVAKAILTKYPQL-EPEFVYGDYPKYN     S---YKT---RK    ATEKL--F-FYSNIM-NFFKTKVT  1049
WP_001040089     987  HHAHDAYLNAVVAKAILTKYPQL-EPEFVYGDYPKYN     S---YKT---RK    ATEKL--F-FYSNIM-NFFKTKVT  1049
WP_001040090     987  HHAHDAYLNAVVAKAILTKYPQL-EPEFVYGDYPKYN     S---YKT---RK    ATEKL--F-FYSNIM-NFFKTKVT  1049
WP_001040091     987  HHAHDAYLNAVVAKAILTKYPQL-EPEFVYGDYPKYN     S---YKT---RK    ATEKL--F-FYSNIM-NFFKTKVT  1049
WP_001040092     987  HHAHDAYLNAVVAKAILTKYPQL-EPEFVYGDYPKYN     S---YKT---RK    ATEKL--F-FYSNIM-NFFKTKVT  1049
WP_001040094     987  HHAHDAYLNAVVAKAILTKYPQL-EPEFVYGDYPKYN     S---YKT---RK    ATEKL--F-FYSNIM-NFFKTKVT  1049
```

| ID | Start | Sequence | End |
|---|---|---|---|
| WP_001040095 | 987 | HHAHDAYLNAVVAKAILTKYPQL-EPEFVVGDYPKYN-S---YKT---RK ATEKL--F-FYSNIM-NFFKTKVT | 1049 |
| WP_001040096 | 987 | HHAHDAYLNAVVAKAILTKYPQL-EPEFVVGDYPKYN-S---YKT---RK ATEKL--F-FYSNIM-NFFKTKVT | 1049 |
| WP_001040097 | 987 | HHAHDAYLNAVVAKAILTKYPQL-EPEFVVGDYPKYN-S---YKT---RK ATEKL--F-FYSNIM-NFFKTKVT | 1049 |
| WP_001040098 | 987 | HHAHDAYLNAVVAKAILTKYPQL-EPEFVVGDYPKYN-S---YKT---RK ATEKL--F-FYSNIM-NFFKTKVT | 1049 |
| WP_001040099 | 987 | HHAHDAYLNAVVAKAILTKYPQL-EPEFVVGDYPKYN-S---YKT---RK ATEKL--F-FYSNIM-NFFKTKVT | 1049 |
| WP_001040100 | 987 | HHAHDAYLNAVVAKAILTKYPQL-EPEFVVGDYPKYN-S---YKT---RK ATEKL--F-FYSNIM-NFFKTKVT | 1049 |
| WP_001040104 | 987 | HHAHDAYLNAVVAKAILTKYPQL-EPEFVVGDYPKYN-S---YKT---RK ATEKL--F-FYSNIM-NFFKTKVT | 1049 |
| WP_001040105 | 987 | HHAHDAYLNAVVAKAILTKYPQL-EPEFVVGDYPKYN-S---YKT---RK ATEKL--F-FYSNIM-NFFKTKVT | 1049 |
| WP_001040106 | 987 | HHAHDAYLNAVVAKAILTKYPQL-EPEFVVGDYPKYN-S---YKT---RK ATEKL--F-FYSNIM-NFFKTKVT | 1049 |
| WP_001040107 | 987 | HHAHDAYLNAVVAKAILTKYPQL-EREFVVGDYPKYN-S---YKT---RK ATEKL--F-FYSNIM-NFFKTKVT | 1049 |
| WP_001040108 | 987 | HHAHDAYLNAVVAKAILTKYPQL-EPEFVVGDYPKYN-S---YKT---RK ATEKL--F-FYSNIM-NFFKTKVT | 1049 |
| WP_001040109 | 987 | HHAHDAYLNAVVAKAILTKYPQL-EPEFVVGDYPKYN-S---YKT---RK ATEKL--F-FYSNIM-NFFKTKVT | 1049 |
| WP_001040110 | 987 | HHAHDAYLNAVVAKAILTKYPQL-EPEFVVGDYPKYN-S---YKT---RK ATEKL--F-FYSNIM-NFFKTKVT | 1049 |
| WP_015058523 | 987 | HHAHDAYLNAVVAKAILTKYPQL-EPEFVVGDYPKYN-S---YKT---RK ATEKL--F-FYSNIM-NFFKTKVT | 1049 |
| WP_017643650 | 987 | HHAHDAYLNAVVAKAILTKYPQL-EPEFVVGDYPKYN-S---YKT---RK ATEKL--F-FYSNIM-NFFKTKVT | 1049 |
| WP_017647151 | 987 | HHAHDAYLNAVVAKAILTKYPQL-EPEFVVGDYPKYN-S---YKT---RK ATEKL--F-FYSNIM-NFFKTKVT | 1049 |
| WP_017648376 | 987 | HHAHDAYLNAVVAKAILTKYPQL-EPEFVVGDYPKYN-S---YKT---RK ATEKL--F-FYSNIM-NFFKTKVT | 1049 |
| WP_017649527 | 987 | HHAHDAYLNAVVAKAILTKYPQL-EPEFVVGDYPKYN-S---YKT---RK ATEKL--F-FYSNIM-NFFKTKVT | 1049 |
| WP_017771611 | 987 | HHAHDAYLNAVVAKAILTKYPQL-EPEFVVGDYPKYN-S---YKT---RK ATEKL--F-FYSNIM-NFFKTKVT | 1049 |
| WP_017771984 | 987 | HHAHDAYLNAVVAKAILTKYPQL-EPEFVVGDYPKYN-S---YKT---RK ATEKL--F-FYSNIM-NFFKTKVT | 1049 |
| CFQ25032 | 987 | HHAHDAYLNAVVAKAILTKYPQL-EPEFVVGDYPKYN-S---YKT---RK ATEKL--F-FYSNIM-NFFKTKVT | 1049 |
| CFV16040 | 987 | HHAHDAYLNAVVAKAILTKYPQL-EPEFVVGDYPKYN-S---YKT---RK ATEKL--F-FYSNIM-NFFKTKVT | 1049 |
| KLJ37842 | 987 | HHAHDAYLNAVVAKAILTKYPQL-EPEFVVGDYPKYN-S---YKT---RK ATEKL--F-FYSNIM-NFFKTKVT | 1049 |
| KLJ72361 | 987 | HHAHDAYLNAVVAKAILTKYPQL-EPEFVVGDYPKYN-S---YKT---RK ATEKL--F-FYSNIM-NFFKTKVT | 1049 |
| KLL20707 | 1001 | HHAHDAYLNAVVAKAILTKYPQL-EPEFVVGDYPKYN-S---YKT---RK ATEKL--F-FYSNIM-NFFKTKVT | 1063 |
| KLL42645 | 987 | HHAHDAYLNAVVAKAILTKYPQL-EPEFVVGDYPKYN-S---YKT---RK ATEKL--F-FYSNIM-NFFKTKVT | 1049 |
| WP_047207273 | 987 | HHAHDAYLNAVVAKAILTKYPQL-EPEFVVGDYPKYN-S---YKT---RK ATEKL--F-FYSNIM-NFFKTKVT | 1049 |
| WP_047209694 | 987 | HHAHDAYLNAVVAKAILTKYPQL-EPEFVVGDYPKYN-S---YKT---RK ATEKL--F-FYSNIM-NFFKTKVT | 1049 |
| WP_050198062 | 987 | HHAHDAYLNAVVAKAILTKYPQL-EPEFVVGDYPKYN-S---YKT---RK ATEKL--F-FYSNIM-NFFKTKVT | 1049 |
| WP_050201642 | 987 | HHAHDAYLNAVVAKAILTKYPQL-EPEFVVGDYPKYN-S---YKT---RK ATEKL--F-FYSNIM-NFFKTKVT | 1049 |
| WP_050204027 | 987 | HHAHDAYLNAVVAKAILTKYPQL-EPEFVVGDYPKYN-S---YKT---RK ATEKL--F-FYSNIM-NFFKTKVT | 1049 |
| WP_050881965 | 987 | HHAHDAYLNAVVAKAILTKYPQL-EPEFVVGDYPKYN-S---YKT---RK ATEKL--F-FYSNIM-NFFKTKVT | 1049 |
| WP_050886065 | 987 | HHAHDAYLNAVVAKAILTKYPQL-EPEFVVGDYPKYN-S---YKT---RK ATEKL--F-FYSNIM-NFFKTKVT | 1049 |
| AHN30376 | 987 | HHAHDAYLNAVVAKAILTKYPQL-EPEFVVGDYPKYN-S---YKT---RK ATEKL--F-FYSNIM-NFFKTKVT | 1049 |
| EAO78426 | 987 | HHAHDAYLNAVVAKAILTKYPQL-EPEFVVGDYPKYN-S---YKT---RK ATEKL--F-FYSNIM-NFFKTKVT | 1049 |
| CCW42055 | 987 | HHAHDAYLNAVVAKAILTKYPQL-EPEFVVGDYPKYN-S---YKT---RK ATEKL--F-FYSNIM-NFFKTKVT | 1049 |
| WP_003041502 | 981 | HHAHDAYLNAVIGTALLKKYPKL-ASEFVVGEFKKYDV S---DK---eIG KATAK--YfFYSNLM-NFFKKEVK | 1050 |
| WP_037593752 | 982 | HHAHDAYLNAVVGNALLKKYPQL-EPEFVVGDYPKYN-S---YR----sRK SATEK--FlFYSNIL-RPFKKE-- | 1042 |
| WP_049516684 | 982 | HHAHDAYLNAVVGNALLKKYPQL-EPEFVVGDYPKYN-S---YR----sRK SATEK--FlFYSNIL-RPFKKE-- | 1042 |
| GAD46167 | 991 | HHAHDAYLNAVVGNALLKKYPQL-EPEFVVGDYPKYN-S---SDDhseMG KATAK--YfFYSNLM-NFFKRVIR | 1062 |
| WP_003043819 | 981 | HHAHDAYLNAVGTALIKKYPKL-ESEFVVGEYKKYDV S---EQEi--GK ATAKR--F-FYSNIM-NFFKTEVK | 1041 |
| WP_006269658 | 987 | HHAHDAYLNAVVGNALLKKYPQL-EPEFVVGDYPKYN-S---YR----sRK SATEK--F1FYSNIL-RPFKKE-- | 1051 |
| WP_048800889 | 981 | HHAHDAYLNAVVGTALLKKYPKL-TSEFVVGEYKKYDV S---DND---eIG KATAK--YfFYSNLM-NFFKTEIT | 1050 |
| WP_012767106 | 981 | HHAHDAYLNAVVGTALLIKKYTKL-ESEFVVGEYKKYDV S---EQEi--GK ATAKR--F-FYSNIM-NFFKTEIT | 1050 |
| WP_014612333 | 981 | HHAHDAYLNAVVGTALIKKYPKL-ESEFVVGDYKVYDV S---EQEi--GK ATAKR--F-FYSNIM-NFFKTEIT | 1050 |
| WP_015017095 | 981 | HHAHDAYLNAVVGTALIKKYPKL-ESEFVVGDYKVYDV S---EQEi--GK ATAKR--F-FYSNIM-NFFKTEIT | 1050 |
| WP_015057649 | 981 | HHAHDAYLNAVVGTALIKKYPKL-ESEFVVGDYKVYDV S---EQEi--GK ATAKR--F-FYSNIM-NFFKTEIT | 1050 |
| WP_048272215 | 981 | HHAHDAYLNAVVGTALIKKYPKL-ESEFVVGDYKVYDV S---EQEi--GK ATAKR--F-FYSNIM-NFFKTEVK | 1050 |
| WP_049519324 | 981 | HHAHDAYLNAVVAKAILGKYPQL-APEFVVGDYPKYN-S---FKEr--QK ATQKM--L-FYSNIL-KFFKDQES | 1043 |
| WP_012515931 | 981 | HHAHDAYLNAVVAKAILGKYPQL-APEFVVGDYPKYN-S---FKEr--QK ATQKT--L-FYSNIL-KFFKDQES | 1043 |
| WP_021320964 | 981 | HHAHDAYLNAVVAKAILGKYPQL-APEFVVGDYPKYN-S---FKEr--QK ATQKT--L-FYSNIL-KFFKDQES | 1043 |
| WP_037581760 | 981 | HHAHDAYLNAVVAKAILGKYPQL-APEFVVGDYPKYN-S---FKEr--QK ATQKT--L-FYSNIL-KFFKDQES | 1043 |
| WP_004232481 | 989 | HHAHDAYLNAVVGTALLKKYPKL-APEFVVGEYKKYDV S---SDNhseLG KATAK--YfFYSNLM-NFFKTEVK | 1061 |

```
-continued
WP_009854540  990  HHAHDAYLNAVVGTALLKKYPKL-ASEFVVGEYKKYDI  S---SD------           KATAK-YfFYSNLM-NFFKTKVK  1056
WP_012962174  990  HHAHDAYLNAVVGTALLKKYPKL-APEFVVGEYKKYDI  S---GD------           KATAK-yfFYSNLM-NFFKRVlR  1056
WP_039695303  992  HHAHDAYLNAVVGTALLKKYPKL-ASEFVVGEYKKYDI  S---SD------           KATAK-yfFYSNLM-NFFKTKVK  1058
WP_014334983  989  HHAHDAYLNAVVGTALLKKYPKL-TPEFVVGEYKKYDV  S---SDyseMG            ATTRM-yFFYSNLM-NFFKTEVK  1061
WP_003099269  982  HHAQDAYLNAVVGTALLKKYPKL-EAEFVVGDYKHYDL  P---DSS1--GK           ATTRM--F-FYSNLM-NFFKKEIK  1051
AHY15608      982  HHAQDAYLNAVVGTALLKKYPKL-EAEFVVGDYKHYDL  P---DSS1--GK           ATTRM--F-FYSNLM-NFFKKEIK  1051
AHY17476      982  HHAQDAYLNAVVGTALLKKYPKL-EAEFVVGDYKHYDL  P---DSS1--GK           ATTRM--F-FYSNLM-NFFKKEIK  1051
ESR09100           ----------------------------------------  ---------              --------------------     
AGM98575      982  HHAQDAYLNAVVGTALLKKYPKL-EAEFVVGDYKHYDL  P---DSS1--GK           ATTRM--F-FYSNLM-NFFKKEIK  1051
ALF27331      982  HHAHDAYLNAVIGKALLGVYPQL-EPEFVVGDYPHFH   G---HK---eNK           ATAKK--F-FYSNIM-NFFKKD-  1041
WP_018372492  995  HHAHDAYLNAVIGKALLGVYPQL-EREFVVGSYVKESI  ---FS---RK             ATERM---rMYNNIL-KFISKD-  1055
WP_045618028  985  HHAHDPYLNAVVAKAILKKYPKL-EPEFVVGDYQKYDL  TkdpKEV---EK           ATEKY--F-FYSNLL-NFFKEEVH  1056
WP_045635197  984  HHAHDAYLNAVVAKAILKKYPKL-EPEFVVGEYKKYDL  SkdpKEV---EK           ATEKY--F-FYSNLL-NFFKEEVH  1055
WP_002263549  982  HHAHDAYLNAVIGKALLGVYPQL-EPEFVVGDYPHFH   G---HK---eNK           ATAKK--F-FYSNIM-NFFKKD-  1041
WP_002263887  982  HHAHDAYLNAVIGKALLGVYPQL-EPEFVVGDYPHFH   G---HK---eNK           ATAKK--F-FYSNIM-NFFKKD-  1041
WP_002264920  982  HHAHDAYLNAVIGKALLGVYPQL-EPEFVVGDYPHFH   G---HK---eNK           ATAKK--F-FYSNIM-NFFKKD-  1041
WP_002269043  982  HHAHDAYLNAVIGKALLGVYPQL-EPEFVVGDYPHFH   G---HK---eNK           ATAKK--F-FYSNIM-NFFKKD-  1041
WP_002269448  982  HHAHDAYLNAVIGKALLGVYPQL-EPEFVVGDYPHFH   G---HK---eNK           ATAKK--F-FYSNIM-NFFKKD-  1041
WP_002271977  982  HHAHDAYLNAVIGKALLGVYPQL-EPEFVVGDYPHFH   G---HE---eNK           ATAKK--F-FYSNIM-NFFKKD-  1041
WP_002272766  982  HHAHDAYLNAVIGKALLGVYPQL-EPEFVVGDYPHFH   G---HK---eNK           ATAKK--F-FYSNIM-NFFKKD-  1041
WP_002273241  982  HHAHDAYLNAVIGKALLGVYPQL-EPEFVVGDYPHFH   G---HK---eNK           ATAKK--F-FYSNIM-NFFKKD-  1041
WP_002275430  982  HHAHDAYLNAVIGKALLGVYPQL-EPEFVVGDYPHFH   G---HK---eNK           ATAKK--F-FYSNIM-NFFKKD-  1041
WP_002276448  982  HHAHDAYLNAVIGKALLGVYPQL-EPEFVVGDYPHFH   G---HK---eNK           ATAKK--F-FYSNIM-NMFKSKVK  1046
WP_002277050  984  HHAHDAYLNAVLLVKYPQL-EPEFVVGDYPHFH       S---YR---eRK          ATAKK--F-FYSNIM-NFFKKD-  1041
WP_002277364  982  HHAHDAYLNAVIGKALLGVYPQL-EPEFVVGDYPKYN   G---HK---eNK           ATAKK--F-FYSNIM-NFFKKD-  1041
WP_002279025  982  HHAHDAYLNAVIGKALLGVYPQL-EPEFVVGDYPHFH   G---HK---eNK           ATAKK--F-FYSNIM-NFFKKD-  1041
WP_002279859  982  HHAHDAYLNAVIGKALLGVYPQL-EPEFVVGDYPHFH   G---HK---eNK           ATAKK--F-FYSNIM-NFFKKD-  1041
WP_002280230  982  HHAHDAYLNAVIGKALLGVYPQL-EPEFVVGDYPHFH   G---HE---eNK           ATAKK--F-FYSNIM-NFFKKD-  1041
WP_002281696  982  HHAHDAYLNAVIGKALLGVYPQL-EPEFVVGDYPHFH   G---HK---eNK           ATAKK--F-FYSNIM-NFFKKD-  1041
WP_002282247  984  HHAHDAYLNAVIGKALLGVYPQL-EPEFVVGEYPKYN   S---YR---eRK           ATQKM--F-FYSNIM-NMFKSKVK  1046
WP_002282906  982  HHAHDAYLNAVIGKALLGVYPQL-EPEFVVGDYPHFH   G---HK---eNK           ATAKK--F-FYSNIM-NFFKKD-  1041
WP_002283846  982  HHAHDAYLNAVIGKALLGVYPQL-EPEFVVGDYPHFH   G---HK---eNK           ATAKK--F-FYSNIM-NFFKKD-  1041
WP_002287255  982  HHAHDAYLNAVIGKALLGVYPQL-EPEFVVGDYPHFH   G---HK---eNK           ATAKK--F-FYSNIM-NFFKKD-  1041
WP_002288990  982  HHAHDAYLNAVIGKALLGVYPQL-EPEFVVGDYPHFH   G---HK---eNK           ATAKK--F-FYSNIM-NFFKKD-  1041
WP_002289641  982  HHAHDAYLNAVIGKALLGVYPQL-EPEFVVGDYPHFH   G---HK---eNK           ATAKK--F-FYSNIM-NFFKKD-  1041
WP_002290427  982  HHAHDAYLNAVIGKALLGVYPQL-EPEFVVGDYPHFH   G---HK---eNK           ATAKK--F-FYSNIM-NFFKKD-  1041
WP_002295753  982  HHAHDAYLNAVIGKALLGVYPQL-EPEFVVGDYPHFH   G---HK---eNK           ATAKK--F-FYSNIM-NFFKKD-  1041
WP_002296423  982  HHAHDAYLNAVIGKALLGVYPQL-EPEFVVGDYPHFH   G---HK---eNK           ATAKK--F-FYSNIM-NFFKKD-  1041
WP_002304487  996  HHAHDAYLNAVIGKALLGVYPQL-EPEFVVGDYPHFH   G---HK---eNK           ATAKK--F-FYSNIM-NFFKKG-  1055
WP_002305844  982  HHAHDAYLNAVIGKALLGVYPQL-EPEFVVGDYPHFH   G---HK---eNK           ATAKK--F-FYSNIM-NFFKKD-  1041
WP_002307203  982  HHAHDAYLNAVIGKALLGVYPQL-EPEFVVGDYPHFH   G---HE---eNK           ATAKK--F-FYSNIM-NFFKKD-  1041
WP_002310390  982  HHAHDAYLNAVIGKALLGVYPQL-EPEFVVGDYPHFH   G---HK---eNK           ATAKK--F-FYSNIM-NFFKKD-  1041
WP_002352408  982  HHAHDAYLNAVIGKALLGVYPQL-EPEFVVGDYPHFH   G---HK---eNK           ATAKK--F-FYSNIM-NFFKKD-  1041
WP_012997688  982  HHAHDAYLNAVIGKALLGVYPQL-EPEFVVGDYPHFH   G---HK---eNK           ATAKK--F-FYSNIM-NFFKKD-  1041
WP_014677909  982  HHAHDAYLNAVIGKALLGVYPQL-EPEFVVGDYPHFH   G---HK---eNK           ATAKK--F-FYSNIM-NFFKKD-  1041
WP_019312892  982  HHAHDAYLNAVIGKALLGVYPQL-EPEFVVGDYPHFH   G---HK---eNK           ATAKK--F-FYSNIM-NFFKKD-  1041
WP_019313659  982  HHAHDAYLNAVIGKALLGVYPQL-EPEFVVGDYPHFH   G---HK---eNK           ATAKK--F-FYSNIM-NFFKKD-  1041
WP_019314093  982  HHAHDAYLNAVIGKALLGVYPQL-EPEFVVGDYPHFH   G---HE---eNK           ATAKK--F-FYSNIM-NFFKKD-  1041
WP_019315370  982  HHAHDAYLNAVIGKALLGVYPQL-EPEFVVGDYPHFH   G---HK---eNK           ATAKK--F-FYSNIM-NFFKKD-  1041
WP_019803776  982  HHAHDAYLNAVIGKALLGVYPQL-EPEFVVGDYPHFH   G---HK---eNK           ATAKK--F-FYSNIM-NFFKKD-  1041
WP_019805234  982  HHAHDAYLNAVIGKALLGVYPQL-EPEFVVGEYLKYN   S---YR---eRK           ATQKM--F-FYSNIM-NMFKSKVK  1046
WP_024783594  984  HHAHDAYLNAVVVKALLVKYPKL-EPEFVVGDYPHFH   G---HK---eNK           ATAKK--F-FYSNIM-NFFKKD-  1041
WP_024784288  982  HHAHDAYLNAVIGKALLGVYPQL-EPEFVVGDYPHFH   G---HK---eNK           ATAKK--F-FYSNIM-NFFKKD-  1041
WP_024784666  982  HHAHDAYLNAVIGKALLGVYPQL-EPEFVVGDYPHFH   G---HK---eNK           ATAKK--F-FYSNIM-NFFKKD-  1041
```

-continued

| | | | |
|---|---|---|---|
| WP_024784894 | 982 | HHAHDAYLNAVIGKALLGVYPQL-EPEFVYGDYPHFH- | G---HK---eNK ATAKK--F-FYSNIM-NPFKKD- 1041 |
| WP_024786433 | 984 | HHAHDAYLNAVVKALLVKYPKL-EPEFVYGDYPHFH- | S---YR---eRK ATQKM--F-FYSNIM-NMFKSKVK 1046 |
| WP_049473442 | 982 | HHAHDAYLNAVIGKALLGVYPQL-EPEFVYGDYPHFH- | G---HE---eNK ATAKK--F-FYSNIM-NPFKKD- 1041 |
| WP_049474547 | 975 | HHAHDAYLNAVIGKALLGVYPQL-EPEFVYGDYPHFH- | G---HK---eNK ATAKK--F-FYSNIM-NPFKKD- 1034 |
| EMC03581 | 987 | HHAHDAYLNAVVAKAILKKYPKL-EPEFVYGDYQKYDL | SkdpKEI---EK ATEKY--F-FYSNLL-NFFKEEVH 1058 |
| WP_000428612 | 985 | HHAHDAYLNAVVAKAILKKYPKL-EPEFVYGDYQKYDL | SrmpKEV---EK ATEKY--F-FYSNLL-NFFKEEVH 1056 |
| WP_000428613 | 980 | HHAHDAYLNAVVAKAILKKYPKL-EPEFVYGDYQKYDL | TkdpKEI---EK ATEKY--F-FYSNLL-NFFKDKVY 1051 |
| WP_049523028 | 951 | HHAHDAYLNAVVGTALLKKYPKL-EAEFVYGDYKHYDL | S---DTS1--GK ATAKM--F-FYSNIM-NFFKKEVR 1020 |
| WP_003107102 | 983 | HHAHDAYLNAVVGTALLKMYPKL-ASEFVYGDYQKYDL | S---GKAs--GH ATAKY--F-FYSNIM-NFFKSEVK 1052 |
| WP_054279288 | 985 | HHAHDAYLNAVVAKAILKKYPKL-EPEFVYGDYQKYDL | SrdpKEI---EK ATEKY--F-FYSNIM-NFFKEEVH 1056 |
| WP_049531101 | 987 | HHAHDAYLNAVVAKAILKKYPKL-EPEFVYGDYQKYDL | SkdpKDI---EK ATEKY--F-FYSNIM-NFFKEEVH 1058 |
| WP_049538452 | 988 | HHAHDAYLNAVVAKAILKKYPKL-EAEFVYGDYKHFDL | SkdpKDI---EK ATAKV--F-FYSNIM-NFFKEELS 1057 |
| WP_049549711 | 940 | HHAHDAYLNAVVGTALLKKYPKL-EAEFVYGDYKHFDL | S---DPS1--GK ATEKV--F-FYSNLL-NFFKEELS 1009 |
| WP_007896501 | 984 | HHAHDAYLNAVVAKAILKKYPKL-EPEFVYGDYQKYDL | FkpsKEI---EK ATEKY--F-FYSNLL-NFFKEEVL 1055 |
| EFR44625 | 985 | HHAHDAYLNAVVAKAILKKYPKL-EPEFVYGDYQKYDL | SkasNTI---DK ATEKY--F-FYSNIM-NFFKEKVR 1055 |
| WP_002897477 | 987 | HHAHDAYLNAVVAKAILRYPKL-EPEFVYGDYQKYDL | SkdpKEI---EK ATEKM--F-FYSNIM-NMFKTTIK 1056 |
| WP_002906454 | 988 | HHAHDAYLNAVLAKAILKKYPKL-EPEFVYGDYQKYDL | S---YRE---RK ATQKY--F-FYSNLL-NFFKEEVH 1046 |
| WP_009729476 | 985 | HHAHDAYLNAVVAKAILKKYPKL-EPEFVYGDYQKYDL | SrepKEV---EK ATEKV--L-FYSNIM-NFFKEEVH 1060 |
| CQR24647 | 988 | HHAHDAYLNAVVAKAILKKYPKL-EPEFVYGDYQKYDL | SkdpKEV---EK ATEKY--L-FYSNIM-NFFRRVLV 1056 |
| WP_000066813 | 986 | HHAHDAYLNAVVATALLKKYPKL-APEFVYGDYQKYDL | S---YKS---RK ATEKV--L-FYSNIM-NFFRRVLV 1050 |
| WP_009754323 | 986 | HHAHDAYLNAVVATALLKKYPKL-APEFVYGDYQKYDL | S---YKS---RK ATEKV--L-FYSNIM-NFFRRVLV 1050 |
| WP_044674937 | 981 | HHAHDAYLNAVVATALLKKYPKL-ASEFVYGEFKKYDV | S---DK----eIG KATAK--YfFYSNLM-NFFKKEVK 1048 |
| WP_044676715 | 952 | HHAQDAFLVAFLGTNITSNYPKI-EMEYLFKGYQHYLN | ----EV----GK ----g---FVINSM-NYPY-EV- 1007 |
| WP_044680361 | 977 | HHAHDAYIVALIGGFMRDRYPNMhDSKAVYSEYMKMFR | ----NKNq--QK ATAKY--F-FVINSM-NPFKTEIT 1038 |
| AIT42264 | 982 | HHAHDAYLNAVVGTALIKKVYPKL-ESEFVYGDYKVYDV | S---EQEi--GK ATQAK--Y-KMSNII-ERFSQDL 1041 |
| WP_034440723 | 981 | HHAHDAYLNGVIALKLLELYPM-AKDLIYGKYSYHRK | G--------DK ATAKY--F-FYSNIM-NFFKTEIT 1051 |
| AKQ21048 | 982 | HHGHDAYLNAVVATTIMKVYPNL-KPQFVYGQYKKTSM | S---EQEi--GK ATARK--H-FYSNIT-KPFKKEKV 1042 |
| WP_002364836 | 988 | HHGQDAYLNCVVATTLLKVYPNL-APEFVYGEYPKFQT | ----FKE---EK ATAKA--I-IYTNLL-RFFTED- 1047 |
| WP_016631044 | 939 | HHGQDAYLNCVVATTLLKVYPNL-APEFVYGEYPKFQT | ----FKE---NK ATAKA--I-IYTNLL-RFFTED- 998 |
| EMS75795 | 723 | HHGQDAYLNGVVATTLLKVYPNL-APEFVYGEYPKFQA | ----AT----eNK ATAKT--E-FYSNIL-RPFEKE- 782 |
| WP_002373311 | 988 | HHGQDAYLNGVVATLLKVYPNL-APEFVYGEYPKFQT | ----FKE---NK ATAKT--I-IYTNLL-RFFTED- 1047 |
| WP_002378009 | 988 | HHGQDAYLNCVVATTLLKVYPNL-APEFVYGEYPKFQT | ----FKE---NK ATAKA--I-IYTNLL-RFFTED- 1047 |
| WP_002407324 | 988 | HHGQDAYLNCVVATTLLKVYPNL-APEFVYGEYPKFQT | ----FKE---NK AMAKA--I-IYTNLL-RFFTED- 1047 |
| WP_002413717 | 988 | HHGQDAYLNCVVATTLLKVYPNL-APEFVYGEYPKFQT | ----FKE---NK ATAKA--I-IYTNLM-RFFTEV- 1047 |
| WP_010777580 | 988 | HHGQDAYLNCVVATTLLKVYPNL-APEFVYGEYPKFQA | ----FKE---NK ATAKA--I-IYTNLL-RFFTED- 1047 |
| WP_010818269 | 989 | HHGQDAYLNCVVATTLLKVYPNL-APEFVYGEYPKFQT | ----FKE---NK ATVKK--E-FYSNIL-RPFEKE- 1048 |
| WP_010824395 | 988 | HHGQDAYLNCVVATTLLKVYPNL-APEFVYGEYPKFQT | ----AT----eNK ATAKT--E-FYSNIL-RPFEKE- 1047 |
| WP_016622645 | 988 | HHGQDAYLNCVVATTLLKVYPNL-APEFVYGEYPKFQT | ----FKE---NK ATVKK--E-FYSNIM-KFFESD- 1047 |
| WP_033624816 | 988 | HHGQDAYLNCVVATTLLKVYPNL-APEFVYGEYLKFNA | ----HK----aNK ATVKK--E-FYSNIM-KFFESD- 1047 |
| WP_033625576 | 988 | HHAHDAYLNGVVALALLKKVYPNL-APEFVYGEYLKFNA | ----HK----aNK ATVKK--E-FYSNIM-KFFESD- 1047 |
| WP_033789179 | 989 | HHAHDAYLNGVVALALLKKVYPNL-APEFVYGEYLKFNA | ----HK----aNK ATVKK--E-FYSNIM-KFFESD- 1048 |
| WP_002310644 | 989 | HHAHDAYLNGVVALALLKKVYPNL-APEFVYGEYLKFNA | ----HK----aNK ATVKK--E-FYSNIL-KFFESD- 1049 |
| WP_002312694 | 990 | HHAHDAYLNGVVALALLKKVYPNL-APEFVYGEYLKFNA | ----HK----aNK ATVKK--E-FYSNIM-KFFESD- 1049 |
| WP_002314015 | 989 | HHAHDAYLNGVVALALLKKVYPNL-APEFVYGEYLKFNA | ----HK----aNK ATVKK--E-FYSNIM-KFFESD- 1048 |
| WP_002320716 | 990 | HHAHDAYLNGVVALALLKKVYPNL-APEFVYGEYLKFNA | ----HK----aNK ATVKK--E-FYSNIM-KFFESD- 1049 |
| WP_002330729 | 990 | HHAHDAYLNGVVALALLKKVYPNL-APEFVYGEYLKFNA | ----HK----aNK ATVKK--E-FYSNIM-KFFESD- 1049 |
| WP_002335161 | 989 | HHAHDAYLNGVVALALLKKVYPNL-APEFVYGEYLKFNA | ----HK----aNK ATVKK--E-FYSNIM-KFFESD- 1048 |
| WP_002345439 | 990 | HHAHDAYLNGVVALALLKKVYPNL-APEFVYGEYLKFNA | ----HK----aNK ATVKK--E-FYSNIM-KFFESD- 1049 |
| WP_034867970 | 980 | HHAHDAYLNGFIANVLLKRVYPKL-APEFVYGKYVKYSL | ----AR----aNK ATAKK--E-FYSNIL-KPLESD- 1039 |

```
WP_047937432  990  HHAHDAYLNGVIALALLKYPQL-APEFVYGEYLKFNA  ----HK---aNK  ATVKK--E-FYSNIM-KPFESD-  1049
WP_010720994  980  HHAHDAYLNGFIANVLLKRYPKL-APEFVYGKVVKYSL  ----AR---eNK  ATAKK--E-FYSNIL-KFLESD-  1039
WP_010737004  980  HHAHDAYLNGFIANVLLKRYPKL-APEFVYGKVVKYSL  ----AR---eNK  ATAKK--E-FYSNIL-KPFLESD- 1039
WP_034700478  980  HHAHDAYLNGFIANVLLKRYPKL-APEFVYGKVVKYSL  ----AR---eNK  ATAKK--E-FYSNIL-KFLESD-  1039
WP_007209003  978  HHAHDAYLNAVVALSLLRVYPQL-KPEFVYGKNS----  ----IHDq--NK  ATIKK---qFYSNIT-RYFASK-  1037
WP_023519017  974  HHGHDAYLNGVVANSLLRVYPQL-QPEFVYGSYIKGDI  ----NQ---iNK  ATAKK--E-FYSNIM-KFFESE-  1033
WP_010770040  986  HHAHDAYLNGVVATALLKIYPQL-EPEFVYGEFHRFNA  ----YKA---NK  ATAKK--Q-LYTNIM-RFFAED-  1045
WP_048604708  983  HHAHDAYLNGVVANTLLKRYPQL-EPEFVYGEFHRFNA  ----FKE---NK  ATAKK--Q-FYSNLM-EFSKSD-  1042
WP_010750235  983  HHAHDAYLNAVVALALLKKYPRL-APEFVYGSPAKFHL  ----VK---eNK  ATAKK--E-FYSNIL-KFFEKE-  1042
AII16583      1021 HHAHDAYLNAVVGTALIKKYPKL-ESEFVYGDYKVYDV  S---EQEi--GK  ATAKY--F-FYSNIM-NFFKTEIT 1090
WP_029073316  988  HHAHDAYIATILGTYIGHRRESL-DAKYIIGEYQKIFR  ----NKNk--DK  ---KDg---FILNSM-RNLYADK- 1052
WP_031589969  988  HHAHDAYIATILGTYIGHRRESL-DAKYIIGEYKRIFR  ----QKNk--GK  ---NDg---FILNSM-RNIYADK- 1052
KDA45870      973  HHAHDAYLNAVVANLIMAKYPEL-EPEFVYGKYRKTK-  ----FKGl--GK  ATAKN---tLYANVL-YFLKENEV 1034
WP_039099354  991  HHAFDAYLTAFVGLYLLKRYPKL-KPYFVYGEYQKAS-  ----QQ---DK  ---RN--F---NFL-NGLKKD-   1043
AKP02966      1000 HHAQDAYLASFLGTYRLRRPPTD-EMLLMNGEYNKFYG  ----KElysKK  ---SRKN-gF-IISPLV------  1062
WP_010991369  985  HHAHDAYLNGVVANTLLKKYPQL-EPEFVYGDYHQFDW  ----FKA---NK  ATAKK--Q-FYTNIM-LFFAQK-  1044
WP_033838504  985  HHAHDAYLNGVVANTLLKKYPQL-EPEFVYGDYHQFDW  ----FKA---NK  ATAKK--Q-FYTNIM-LFFAQK-  1044
EHN60060      988  HHAHDAYLNGVVANTLLKKYPQL-EPEFVYGDYHQFDW  ----FKA---NK  ATAKK--Q-FYTNIM-LFFAQK-  1047
EFR89594      754  HHAHDAYLNGVVANTLLKKYPQL-EPEFVYGDYHQFDW  ----FKA---NK  ATAKK--Q-FYTNIM-LFFAQK-  813
WP_038409211  985  HHAHDAYLNGVVANTLLKKYPQL-EPEFVYGDYHQFDW  ----FKA---NK  ATAKK--Q-FYTNIM-RFFAKE-  1044
EFR95520      604  HHAHDAYLNGVVANTLLKKYPQL-EPEFVYGDYHQFDW  ----FKA---NK  ATAKK--Q-FYTNIM-RPFAKE-  663
WP_003723650  985  HHAHDAYLNGVVANTLLKKYPQL-EPEFVYGEYHQFDW  ----FKA---NK  ATAKK--Q-FYTNIM-LFFAQK-  1044
WP_003727705  985  HHAHDAYLNGVVANTLLKKYPQL-EPEFVYGEYHQFDW  ----FKA---NK  ATAKK--Q-FYTNIM-LFFAQK-  1044
WP_003730785  985  HHAHDAYLNGVVANTLLKKYPQL-EPEFVYGEYHQFDW  ----FKA---NK  ATAKK--Q-FYTNIM-LFFAQK-  1044
WP_003733029  985  HHAHDAYLNGVVANTLLKKYPQL-EPEFVYGEYHQFDW  ----FKA---NK  ATAKK--Q-FYTNIM-LFFAQK-  1044
WP_003739838  985  HHAHDAYLNGVVANTLLKKYPQL-EPEFVYGEYHQFGW  ----FKA---NK  ATAKK--Q-FYTNIM-LFFAQK-  1044
WP_014601172  985  HHAHDAYLNGVVANTLLKKYPQL-EPEFVYGEYHQFDW  ----FKA---NK  ATAKK--Q-FYTNIM-LFFGQK-  1044
WP_023548323  985  HHAHDAYLNGVVANTLLKKYPQL-EPEFVYGEYHQFDW  ----FKA---NK  ATAKK--Q-FYTNIM-LFFAQK-  1044
WP_031665337  985  HHAHDAYLNGVVANTLLKKYPQL-EPEFVYGEYHQFDW  ----FKA---NK  ATAKK--Q-FYTNIM-LFFAQK-  1044
WP_031669209  985  HHAHDAYLNGVVANTLLKKYPQL-EPEFVYGEYHQFDW  ----FKA---NK  ATAKK--Q-FYTNIM-LFFAQK-  1044
WP_033920898  985  HHAHDAYLNGVVANTLLKKYPQL-EPEFVYGEYHQFDW  ----FKA---NK  ATAKK--Q-FYTNIM-LFFGQK-  1044
AKI42028      988  HHAHDAYLNGVVANTLLKKYPQL-EPEFVYGEYHQFDW  ----FKA---NK  ATAKK--Q-FYTNIM-LFFAQK-  1047
AKI50529      433  HHAHDAYLNCVVANTLLKKYPQL-EPEFVYGDYHQFDW  ----FKA---NK  ATAKK--Q-FYTNIM-LFFAKK-  492
EFR83390      985  HHAHDAYLNGVVANTLLKKYPQL-EPEFVYGDYHQFDW  S---EQEi--GK  ATAKK--F-FYSNIM-NFFKTEIT 1044
WP_046323366  998  HHAHDAYIVALIGGFMRDRYPNMhDSKAVYSEYMKMFR  ----NKNg--QK  ---g---FVINSM-NYPY-EV-   1067
AKE81011      981  HHAHDAYIVALIGGFMRDRYPNMhDSKAVYSEYMKMFR  ----NKNg--QK  ---g---FVINSM-NYPY-EV-   1067
CUO82355      981  HHAHDAYIVALIGGFMRDRYPNMhDSKAVYSEYMKMFR  ----NKNg--QK  ---g---FVINSM-NYPY-EV-   1042
WP_033162887  983  HHAHDAYIACIVGQPMHQNPEHL-DAKIIYGQYK----  ----KNy--KK  ---NYg---FILNSM-NHLQSDI  1084
AGZ01981      1015 HHAHDAYLNAVVGTALIKKYPKL-ESEFVYGDYKVYDV  S---EQEi--GK  ATAKY--F-FYSNIM-NFFKTEIT 1051
AKA60242      982  HHAHDAYLNAVVGTALIKKYPKL-ESEFVYGDYKVYDV  S---EQEi--GK  ATAKY--F-FYSNIM-NFFKTEIT 1051
AKS40380      982  HHAHDAYLNAVVGTALIKKYPKL-ESEFVYGDYKVYDV  S---EQEi--GK  ATAKY--F-FYSNIM-NFFKTEIT 1051
4UN5_B        986  HHAHDAYLNAVVGTALIKKYPKL-ESEFVYGDYKVYDV  S---EQEi--GK  ATAKY--F-FYSNIM-NFFKTEIT 1055

WP_010922251  1052 LAN-GEIRKRPLIE  TNGET-GE-IVWDKGRDFATVRKVLS-MPQVNIVKKTEVQT  GGFSK  ESIL-PKR-  1114

WP_039695303  1059 YAD-GTVFERPIIE  T-NAD-GE-IAWNKQIDFEKVRKVLS-YPQVNIVKKVETQT  GGFSK  ESIL-PKG-  1120
WP_045635197  1056 YAD-GTIVKRENIE  Y-SKDtGE-IAWNKEKDFAIIKKVLS-LPQVNIVKKRREVQT GGFSK  ESIL-PKG-  1118
5AXW_A        772  YKYsHRVDKKPNRE  VNNLN-GL---YDKDND--KLKKLINkSPEKLLMYHHDPQT  --YQK  KLIMeQYGd  852
WP_009880683  736  LAN-GEIRKRPLIE  TNGET-GE-IVWDKGRDFATVRKVLS-MPQVNIVKKTEVQT  GGFSK  ESIL-PKR-  798
WP_010922251  1052 LAN-GEIRKRPLIE  TNGET-GE-IVWDKGRDFATVRKVLS-MPQVNIVKKTEVQT  GGFSK  ESIL-PKR-  1114
WP_011054416  1052 LAN-GEIRKRPLIE  TNGET-GE-IVWDKGRDFATVRKVLS-MPQVNIVKKTEVQT  GGFSK  ESIL-PKR-  1114
WP_011284745  1052 LAN-GEIRKRPLIE  TNGET-GE-IVWDKGRDFATVRKVLS-MPQVNIVKKTEVQT  GGFSK  ESIL-PKR-  1114
WP_011285506  1052 LAN-GEIRKRPLIE  TNGET-GE-IVWDKGRDFATVRKVLS-MPQVNIVKKTEVQT  GGFSK  ESIL-PKR-  1114
WP_011527619  1052 LAN-GEIRKRPLIE  TNGET-GE-IVWDKGRDFATVRKVLS-MPQVNIVKKTEVQT  GGFSK  ESIL-PKR-  1114
```

| ID | | | | | |
|---|---|---|---|---|---|
| WP_012560673 | 1052 | LAN-GEIRKRPLIE | TNGET-GE-IVWDKGRDFATVRKVLS-MPQVNIVKKTEVQT | GGFSK | ESIL-PKR- | 1114 |
| WP_014407541 | 1051 | LAN-GEIRKRPLIE | TNGET-GE-IVWDKGRDFATVRKVLS-MPQVNIVKKTEVQT | GGFSK | ESIL-PKR- | 1113 |
| WP_020905136 | 1052 | LAN-GEIRKRPLIE | TNGET-GE-IVWDKGRDFATVRKVLS-MPQVNIVKKTEVQT | GGFSK | ESIL-PKR- | 1114 |
| WP_023080005 | 1051 | LAN-GEIRKRPLIE | TNGET-GE-IVWDKGRDFATVRKVLS-MPQVNIVKKTEVQT | GGFSK | ESIL-PKR- | 1113 |
| WP_023610282 | 1051 | LAN-GEIRKRPLIE | TNGET-GE-IVWDKGRDFATVRKVLS-MPQVNIVKKTEVQT | GGFSK | ESIL-PKR- | 1113 |
| WP_030125963 | 1052 | LAN-GEIRKRPLIE | TNGET-GE-IVWDKGRDFATVRKVLS-MPQVNIVKKTEVQT | GGFSK | ESIL-PKR- | 1114 |
| WP_030126706 | 1052 | LAN-GEIRKRPLIE | TNGET-GE-IVWDKGRDFATVRKVLS-MPQVNIVKKTEVQT | GGFSK | ESIL-PKR- | 1114 |
| WP_031488318 | 1052 | LAN-GEIRKRPLIE | TNGET-GE-IVWDKGRDFATVRKVLS-MPQVNIVKKTEVQT | GGFSK | ESIL-PKR- | 1114 |
| WP_032460140 | 1052 | LAN-GEIRKRPLIE | TNGET-GE-IVWDKGRDFATVRKVLS-MPQVNIVKKTEVQT | GGFSK | ESIL-PKR- | 1114 |
| WP_032461047 | 1052 | LAN-GEIRKRPLIE | TNGET-GE-IVWDKGRDFATVRKVLS-MPQVNIVKKTEVQT | GGFSK | ESIL-PKR- | 1114 |
| WP_032462016 | 1052 | LAN-GEIRKRPLIE | TNGET-GE-IVWDKGRDFATVRKVLS-MPQVNIVKKTEVQT | GGFSK | ESIL-PKR- | 1114 |
| WP_032462936 | 1052 | LAN-GEIRKRPLIE | TNGET-GE-IVWDKGRDFATVRKVLS-MPQVNIVKKTEVQT | GGFSK | ESIL-PKR- | 1114 |
| WP_032464890 | 877 | LAN-GEIRKRPLIE | TNGET-GE-IVWDKGRDFATVRKVLS-MPQVNIVKKTEVQT | GGFSK | ESIL-PKR- | 939 |
| WP_033888930 | 1052 | LAN-GEIRKRPLIE | TNGET-GE-IVWDKGRDFATVRKVLS-MPQVNIVKKTEVQT | GGFSK | ESIL-PKR- | 1114 |
| WP_038431314 | 1051 | LAN-GEIRKRPLIE | TNGET-GE-IVWDKGRDFATVRKVLS-MPQVNIVKKTEVQT | GGFSK | ESIL-PKR- | 1113 |
| WP_038432938 | 1052 | LAN-GEIRKRPLIE | TNGET-GE-IVWDKGRDFATVRKVLS-MPQVNIVKKTEVQT | GGFSK | ESIL-PKR- | 1114 |
| WP_038434062 | 963 | LAN-GEIRKRPLIE | TNGET-GE-IVWDKGRDFATVRKVLS-MPQVNIVKKTEVQT | GGFSK | ESIL-PKR- | 1025 |
| BAQ51233 | 227 | LAN-GEIRKRPLIE | TNGET-GE-IVWDKGRDFATVRKVLS-MPQVNIVKKTEVQT | GGFSK | ESIL-PKR- | 289 |
| KGE60162 | 1 | ---------IE | ------------ | | | 52 |
| KGE60856 | 1052 | LAN-GEIRKRPLIE | TNGET-GE-IVWDKGRDFATVRKVLS-MPQVNIVKKTEVQT | GGFSK | ESIL-PKR- | 1114 |
| WP_002989955 | 1042 | ---------DIQ | T-NED-GE-IAWNKEKHIKILRKVLS-YPQVNIVKKTEEQT | GGFSK | ESIL-PKG- | 1093 |
| WP_003030002 | 1059 | YSN-GKVIVRPVVE | Y-SKD-TEdIAWDKKSNERTICKVLS-YPQVNIVKKVETQT | GGFSK | ESIL-PKG- | 1121 |
| WP_003065552 | 1058 | LAD-GTVVKDDIE | VNNDT-GE-IVWDKKKHFATVRKVLS-YPQVNIVKKTEIQT | GGFSK | ESIL-AHG- | 1120 |
| WP_001040076 | 1050 | GSI-GTVVRPVIE | TGRYM-GK-TAWDKKKHFATVRKVLS-YPQVNIVKKTEIQT | GGFSK | ESIL-AHG- | 1112 |
| WP_001040078 | 1050 | LAD-GTVVKDDIE | VNNDT-GE-IVWDKKKHFATVRKVLS-YPQVNIVKKTEIQT | GGFSK | ESIL-AHG- | 1112 |
| WP_001040080 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040081 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040083 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040085 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040087 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040088 | 1050 | LAD-GTVVKDDIE | VNNDT-GE-IVWDKKKHFATVRKVLS-YPQNNIVKKTEBQT | GGFSK | ESIL-AHG- | 1112 |
| WP_001040089 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040090 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040091 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040092 | 1050 | ETV-GTVVKDDIE | VNNET-GE-IVWDKKKHFATVRKVLS-YPQNNIVKKTEVQT | GGFSK | ESIL-AHS- | 1112 |
| WP_001040094 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040095 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040096 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040097 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040098 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040099 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040100 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040104 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040105 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040106 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040107 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040108 | 1050 | LAD-GTVVKDDIE | VNNDT-GE-IVWDKKKHFATVRKVLS-YPQNNIVKKTEIQT | GGFSK | ESIL-AHG- | 1112 |
| WP_001040109 | 1050 | LAD-GTVVKDDIE | VNNDT-GE-IAWDKKKHFATVRKVLS-YPQNNIVKKTEIQT | GGFSK | ESIL-AHG- | 1112 |
| WP_001040110 | 1050 | ETV-GTVVKDDIE | VNNET-GE-IVWDKKKHFATVRKVLS-YPQNNIVKKTEVQT | GGFSK | ESIL-AHS- | 1112 |
| WP_015058523 | 1050 | LAD-GTVVKDDIE | VNNDT-GE-IVWDKKKHFATVRKVLS-YPQNNIVKKTEIQT | GGFSK | ESIL-AHG- | 1112 |
| WP_017643650 | 1050 | LAD-GTVVKDDIE | VNNDT-GE-IVWDKKKHFATVRKVLS-YPQNNIVKKTEIQT | GGFSK | ESIL-AHS- | 1112 |
| WP_017647151 | 1050 | LAD-GTVVKDDIE | VNNDT-GE-IVWDKKKHFATVRKVLS-YPQNNIVKKTEIQT | GGFSK | ESIL-AHG- | 1112 |
| WP_017648376 | 1050 | LAD-GTVVKDDIE | VNNDT-GE-IVWDKKKHFATVRKVLS-YPQNNIVKKTEIQT | GGFSK | ESIL-AHG- | 1112 |
| WP_017649527 | 1050 | LAD-GTVVKDDIE | VNNDT-GE-IVWDKKKHFATVRKVLS-YPQNNIVKKTEIQT | GGFSK | ESIL-AHG- | 1112 |

| | | | | |
|---|---|---|---|---|
| WP_017771611 | 1050 | LAD-GTVVVKDDIE | VNNDT-GE-IVWDKKKKHFATVRKVLS-YPQNNIVKKTEIQT | GGFSK | ESIL-AHG- | 1112 |
| WP_017771984 | 1050 | LAD-GTVVVKDDIE | VNNDT-GE-IVWDKKKKHFATVRKVLS-YPQNNIVKKTEIQT | GGFSK | ESIL-AHG- | 1112 |
| CFQ25032 | 1050 | LAD-GTVVVKDDIE | VNNDT-GE-IVWDKKKKHFATVRKVLS-YPQNNIVKKTEIQT | GGFSK | ESIL-AHG- | 1112 |
| CFV16040 | 1050 | LAD-GTVVVKDDIE | VNNDT-GE-IVWDKKKKHFATVRKVLS-YPQNNIVKKTEIQT | GGFSK | ESIL-AHG- | 1112 |
| KLJ37842 | 1050 | LAD-GTVVVKDDIE | VNNDT-GE-IVWDKKKKHFATVRKVLS-YPQNNIVKKTEIQT | GGFSK | ESIL-AHG- | 1112 |
| KLJ72361 | 1064 | LAD-GTVVVKDDIE | VNNDT-GE-IVWDKKKKHFATVRKVLS-YPQNNIVKKTEIQT | GGFSK | ESIL-AHG- | 1126 |
| KLL20707 | 1050 | LAD-GTVVVKDDIE | VNNDT-GE-IVWDKKKKHFATVRKVLS-YPQNNIVKKTEIQT | GGFSK | ESIL-AHG- | 1112 |
| KLL42645 | 1050 | LAD-GTVVVKDDIE | VNNDT-GE-IVWDKKKKHFATVRKVLS-YPQNNIVKKTEIQT | GGFSK | ESIL-AHG- | 1112 |
| WP_047207273 | 1050 | LAD-GTVVVKDDIE | VNNDT-GE-IVWDKKKKHFATVRKVLS-YPQNNIVKKTEIQT | GGFSK | ESIL-AHG- | 1112 |
| WP_047209694 | 1050 | LAD-GTVVIKDDIE | VNNDT-GE-IVWDKKKKHFATVRKVLS-YPQNNIVKKTEIQT | GGFSK | ESIL-AHG- | 1112 |
| WP_050198062 | 1050 | LAD-GTVVVKDDIE | VNNDT-GE-IVWDKKKKHFATVRKVLS-YPQNNIVKKTEIQT | GGFSK | ESIL-AHG- | 1112 |
| WP_050201642 | 1050 | LAD-GTVVVKDDIE | VNNDT-GE-IVWDKKKKHFATVRKVLS-YPQNNIVKKTEIQT | GGFSK | ESIL-AHG- | 1112 |
| WP_050204027 | 1050 | LAD-GTVVVKDDIE | VNNDT-GE-IVWDKKKKHFATVRKVLS-YPQNNIVKKTEIQT | GGFSK | ESIL-AHG- | 1112 |
| WP_050881965 | 1050 | LAD-GTVVVKDDIE | VNNDT-GE-IAWNKEKHFATVRKVLS-YPQNNIVKKTEIQT | GGFSK | ESIL-AHG- | 1112 |
| WP_050886065 | 1050 | LAD-ETVVVKDDIE | VNNET-GE-IAWDKKKKHFATVRKVLS-YPQVNIVKKTEVQT | GGFSK | ESIL-AHS- | 1112 |
| AHN30376 | 1050 | LAD-ETVVVKDDIE | VNNDT-GE-IVWDKKKKHFATVRKVLS-YPQVNIVKKTEVQT | GGFSK | ESIL-AHG- | 1112 |
| EAO78426 | 1050 | FAD-GTVVVKDDIE | VNNDT-GE-IVWDKKKKHFATVRKVLS-YPQNNIVKKTEIQT | HGLDR | PSPK-PKP- | 1112 |
| CCW42055 | 1051 | FAD-GTVVERPDIE | T-SED-GE-IAWNKQTDFKIVRKVLS-YPQVNIVKKTEEQT | GGFSK | ESIL-PKG- | 1122 |
| WP_003041502 | 1043 | -------DIQ | T-NED-GE-IAWNKEKHIKILRKVLS-YPQVNIVKKTEEQT | GGFSK | ESIL-PKG- | 1094 |
| WP_037593752 | 1043 | -------DIQ | T-NED-GE-IAWNKEKHIKILRKVLS-YPQVNIVKKTEEQT | GGFSK | ESIL-SKR- | 1094 |
| WP_049516684 | 1042 | -------DIQ | T-NED-GE-IAWNKEKHIKILRKVLS-YPQVNIVKKTEEQT | GGFSK | ESIL-PKG- | 1093 |
| GAD46167 | 1063 | YSN-GKVIVRPVVE | Y-SKD-GE-IAWNKRTDFEKVRKVLS-YPQVNIVKVETQT | GGFSK | ESIL-PKG- | 1125 |
| WP_018363470 | 1061 | LAN-GEIRKRPLIE | TNGET-GE-VVWNKEKDFATVRKVLA-MPQVNIVKKTEVQT | GGFSK | ESIL-SKR- | 1123 |
| WP_003043819 | 1042 | -------DIQ | T-NED-GE-IAWNKEKHIKILRKVLS-YPQVNIVKVETQT | GGFSK | ESIL-PKG- | 1093 |
| WP_006269658 | 1052 | FAD-GTVVERPDIE | T-SED-GE-IVWDKGRDFATVRKVLS-MPQVNIVKKTEVQT | GRFSK | ESIL-PKG- | 1113 |
| WP_048800889 | 1051 | LAN-GEIRKRPLIE | TNEET-GE-IVWDKGRDFATVRKVLS-MPQVNIVKKTEVQT | GALTN | ESIY-ARG- | 1113 |
| WP_012767106 | 1051 | LAN-GEIRKRPLIE | TNEET-GE-IVWDKGRDFATVRKVLS-MPQVNIVKKTEVQT | GALTN | ESIY-ARG- | 1113 |
| WP_014612333 | 1051 | LAN-GEIRKRPLIE | TNEET-GE-IVWDKGRDFATVRKVLS-MPQVNIVKKTEVQT | GALTN | ESIY-ARG- | 1113 |
| WP_015017095 | 1051 | LAN-GEIRKRPLIE | TNEET-GE-IVWDKGRDFATVRKVLS-MPQVNIVKKTEVQT | GALTN | ESIY-ARG- | 1113 |
| WP_015057649 | 1051 | LAN-GEIRKRPLIE | TNEET-GE-IVWDKGRDFATVRKVLS-MPQVNIVKKTEVQT | GALTN | ESIY-ARG- | 1113 |
| WP_048272215 | 1044 | L---------H | VNSD-GE-EIWNANKHLPIIKNVLS-IPQVNIVKKTEVQT | GGFYK | ESIL-SKG- | 1094 |
| WP_049519324 | 1044 | L---------H | VNSD-GE-EIWNANKHLPIIKNVLS-IPQVNIVKKTEVQT | GGFYK | ESIL-SKG- | 1094 |
| WP_012515931 | 1062 | YAD-GRVFERPDIE | T-NAD-GE-VVWNKQRDFNIVRKVLS-YPQVNIVKRETQT | GGFSK | ESIL-PKG- | 1123 |
| WP_021320964 | 1057 | YAD-GTVFERPIIE | T-NAD-GE-IAWNKEKDFPFKVRKVLS-YPQVNIVKVETQT | GGFSK | ESIL-PKG- | 1118 |
| WP_037581760 | 1057 | YSN-GKVVVRPVIE | C-SKD-GE-IAWNKQTDFEKVRKVLS-YPQVNIVKVETQT | GGFSK | ESIL-PKG- | 1119 |
| WP_004232481 | 1059 | YAD-GTVFERPDIE | T-NAD-GE-VVWNKQKDFDIVRKVLS-YPQVNIVKVEAQT | GGFSK | ESIL-PKG- | 1120 |
| WP_009854540 | 1062 | YAD-GRVFERPIIE | T-NAD-GE-VVWNKQKDFDIVRKVLS-YPQVNIVKKEVQT | GGFSK | ESIL-SKG- | 1123 |
| WP_012962174 | 1052 | LAD-DTIFTRPQIE | VNTET-GE-IVWDKDMQTIRKVMS-YPQVNIVMKTEVQT | GGFSK | ESIW-PKG- | 1114 |
| WP_039695303 | 1052 | LAD-DTIFTRPQIE | VNTET-GE-IVWDKDMQTIRKVMS-YPQVNIVMKTEVQT | GGFSK | ESIW-PKG- | 1114 |
| WP_014334983 | | | | | | |
| WP_003099269 | | | | | | |
| AHY15608 | | | | | | |
| AHY17476 | | | | | | |
| ESR09100 | | | | | | |
| AGM98575 | 1052 | LAD-DTIFTRPQIE | VNTET-GE-IVWDKVKDMQTIRKVMS-YPQVNIVMKTEVQT | GGFSK | ESIW-PKG- | 1114 |
| ALF27331 | 1042 | ---DVR | T-DKN-GE-IIWKKDEHISNIKKVLS-YPQVNIVKKVEEQT | GGFSK | ESIL-PKG- | 1093 |
| WP_018372492 | 1042 | ----K | --DQEGE-IVWDKKEIENIVKKVIY-SSPVNIVKKVEEQS | GALFK | QSNM-AVGy | 1108 |
| WP_045618028 | 1056 | YAD-GTIVKRENIE | Y-SKDcGE-IAWNKEKDFAIIKKVLS-LPQVNIVKKVEEQT | GALFD | NNIV-SKKk | 1124 |
| WP_045635197 | 1057 | YAD-GTIVKRENIE | Y-SKD-GE-IAWNKEKDFAIIKKVLS-LPQVNIVKKVEEQT | GGLFD | ESIL-PKG- | 1118 |
| WP_002263549 | 1042 | ---DVR | T-DKN-GE-IIWKKDEHISNIKKVLS-YPQVNIVKKVEEQT | GGFSK | ESIL-PKG- | 1093 |
| WP_002263887 | 1042 | ---DVR | T-DKN-GE-IIWKKDEYISNIKKVLS-YPQVNIVKKVEEQT | GGFSK | ESIL-SKG- | 1093 |
| WP_002269043 | 1042 | ---DVR | T-DKN-GE-IIWKKDEHISNIKKVLS-YPQVNIVKKVEEQT | GGFSK | ESIL-PKG- | 1093 |
| WP_002269448 | 1042 | ---DVR | T-DKN-GE-IIWKKDEHISNIKKVLS-YPQVNIVKKVEEQT | GGFSK | ESIL-PKG- | 1093 |

-continued

```
WP_002271977  1042  ----------DVR  T-DKN-GE-IIWKKDEHISNIKKVLS-YPQVNIVKKVEEQT  GGFSK  ESIL-PKG-  1093
WP_002272766  1042  ----------DVR  T-DKN-GE-IIWKKDEHISNIKKVLS-YPQVNIVKKVEEQT  GGFSK  ESIL-PKG-  1093
WP_002273241  1042  ----------DVR  T-DKN-GE-IIWKKDEHISNIKKVLS-YPQVNIVKKVEEQT  GGFSK  ESIL-PKG-  1093
WP_002275430  1042  ----------DVR  T-DKN-GE-IIWKKDEHISNIKKVLS-YPQVNIVKKVEEQT  GGFSK  ESIL-PKG-  1093
WP_002276448  1042  ----------DVR  T-DRN-GE-IIWKKDEHISNIKKVLS-YPQVNIVKKVEEQT  GGFSK  ESIL-PKG-  1093
WP_002277050  1047  LAD-DQIVERPMIE  VNDET-GE-IAWDKTKHITTVKKVLS-YPQVNIVKKVEEQT  GGLFD  -----PKS-  1111
WP_002277364  1042  ----------DVR  T-DKN-GE-IIWKKDEHISNIKKVLS-YPQVNIVKKVEEQT  GGFSK  ESIL-PKG-  1093
WP_002279025  1042  ----------DVR  T-DKN-GE-IIWKKDEHISNIKKVLS-YPQVNIVKKVEEQT  GGFSK  ESIL-PKG-  1093
WP_002279859  1042  ----------DVR  T-DKN-GE-IIWKKDEHISNIKKVLS-YPQVNIVKKVEEQT  GGFSK  ESIL-PKG-  1093
WP_002280230  1042  ----------DVR  T-DKN-GE-IIWKKDEHISNIKKVLS-YPQVNIVKKVEEQT  GGFSK  ESIL-PKG-  1093
WP_002281696  1047  ----------DVR  T-DKN-GE-IIWKKDEHISNIKKVLS-YPQVNIVKKVEEQT  GGLFD  -----PKS-  1111
WP_002282247  1042  LAD-DQIVERPMIE  VNDET-GE-IAWDKTKHITTVKKVLS-YPQVNIVKKVEEQT  GGFSK  ESIL-PKG-  1093
WP_002282906  1042  ----------DVR  I-DKN-GE-IIWKKDEHISNIKKVLS-YPQVNIVKKVEEQT  GGFSK  ESIL-PKG-  1093
WP_002283846  1042  ----------DVR  T-DKN-GE-IIWKKDEHISNIKKVLS-YPQVNIVKKVEEQT  GGFSK  ESIL-PKG-  1093
WP_002287255  1042  ----------DVR  T-DKN-GE-IIWKKDEYISNIKKVLS-YPQVNIVKKVEEQT  GGFSK  ESIL-PKG-  1093
WP_002288990  1042  ----------DVR  T-DKN-GE-IIWKKDEHISNIKKVLS-YPQVNIVKKVEEQT  GGFSK  ESIL-PKG-  1093
WP_002289641  1042  ----------DVR  T-DKN-GE-IIWKKDEHISNIKKVLS-YPQVNIVKKVEEQT  GGFSK  ESIL-PKG-  1093
WP_002290427  1042  ----------DVR  T-DKN-GE-IIWKKDEYISNIKKVLS-YPQVNIVKKVEEQT  GGFSK  ESIL-PKG-  1093
WP_002295753  1042  ----------DVR  T-DKN-GE-IIWKKDEHISNIKKVLS-YPQVNIVKKVEEQT  GGFSK  ESIL-PKG-  1093
WP_002296423  1042  ----------DVR  T-DKN-GE-IIWKKDEHISNIKKVLS-YPQVNIVKKVEEQT  GGFFK  ESIL-PKG-  1093
WP_002304487  1056  ----------DVR  T-DKN-GE-IIWKKDEYISNIKKVLS-YPQVNIVKKVEEQT  GGFSK  ESIL-PKG-  1107
WP_002305844  1042  ----------DVR  T-DKN-GE-IIWKKDEHISNIKKVLS-YPQVNIVKKVEEQT  GGFSK  ESIL-PKG-  1093
WP_002307203  1042  ----------DVR  T-DKN-GE-IIWKKDEHISNIKKVLS-YPQVNIVKKVEEQT  GGFSK  ESIL-PKG-  1093
WP_002310390  1042  ----------DVR  T-DKN-GE-IIWKKDEHISNIKKVLS-YPQVNIVKKVEEQT  GGFFK  ESIL-PKG-  1093
WP_002352408  1042  ----------DVR  T-DKN-GE-IIWKKDEHISNIKKVLS-YPQVNIVKKVEEQT  GGFSK  ESIL-PKG-  1093
WP_012997688  1042  ----------DVR  T-DKN-GE-IIWKKDEHISNIKKVLS-YPQVNIVKKVEEQT  GGFSK  ESIL-PKG-  1093
WP_014677909  1042  ----------DVR  T-DKN-GE-IIWKKDEHISNIKKVLS-YPQVNIVKKVEEQT  GGFSK  ESIL-PKG-  1093
WP_019312892  1042  ----------DVR  T-DKN-GE-IIWKKDEHISNIKKVLS-YPQVNIVKKVEEQT  GGFSK  ESIL-PKG-  1093
WP_019313659  1042  ----------DVR  T-DKN-GE-IIWKKDEYISNIKKVLS-YPQVNIVKKVEEQT  GGFSK  ESIL-PKG-  1093
WP_019314093  1042  ----------DVR  T-DKN-GE-IIWKKDEHISNIKKVLS-YPQVNIVKKVEEQT  GGFSK  ESIL-PKG-  1093
WP_019315370  1042  ----------DVR  T-DKN-GE-IIWKKDEHISNIKKVLS-YPQVNIVKKVEEQT  GGFFK  ESIL-PKG-  1093
WP_019803776  1042  ----------DVR  T-DKN-GE-IIWKKDEHISNIKKVLS-YPQVNIVKKVEEQT  GGFSK  ESIL-PKG-  1093
WP_019805234  1042  ----------DVR  T-DKN-GE-IIWKKDEHISNIKKVLS-YPQVNIVKKVEEQT  GGFSK  ESIL-PKG-  1093
WP_024783594  1042  ----------DVR  T-DKN-GE-IIWKKDEHISNIKKVLS-YPQVNIVKKVEEQT  GGFSK  ESIL-PKG-  1093
WP_024784288  1047  LAD-DQIVERPMIE  VNDET-GE-IAWDKTKHITTVKKVLS-YPQVNIVKKVEEQT  GGLFD  -----PKS-  1111
WP_024784666  1042  ----------DVR  T-DKN-GE-IIWKKDEHISNIKKVLS-YPQVNIVKKVEEQT  GGFSK  ESIL-PKG-  1093
WP_024784894  1047  LAD-DQIVERPMIE  VNDET-GE-IAWDKTKHITTVKKVLS-YPQVNIVKKVEEQT  GGLFD  -----PKS-  1111
WP_024786433  1042  ----------DVR  T-DKN-GE-IIWKKDEHISNIKKVLS-YPQVNIVKKVEEQT  GGFSK  ESIL-PKG-  1093
WP_049473442  1042  ----------DVR  T-DKN-GE-IIWKKDEHISNIKKVLS-YPQVNIVKKVEEQT  GGFSK  ESIL-PKG-  1093
WP_049474547  1035  ----------DVR  T-DKN-GE-IIWKKDEHISNIKKVLS-YPQVNIVKKVEEQT  GGFSK  ESIL-PKG-  1086
EMC03581      1059  YAD-GTIVKRENIE  Y-SKDtGE-IAWNKEKDFATIKKVLS-LPQVNIVKKVEEQT  GGFSK  ESIL-PKG-  1121
WP_000428612  1057  YAD-GTIVKRENIE  Y-SKDGE-IAWNKEKDFATIKKVLS-YPQVNIVKKVEEQT  GGFSK  ESIL-PKG-  1119
WP_000428613  1052  YAD-GTIIQRGNVE  Y-SKDCGE-IAWNKEKRDFAIVRKVLS-YPQVNIVKKVEEQT  GGFSK  ESIL-PKG-  1114
WP_049523028  1021  LAD-GTVITRPQIE  TNTET-GE-IVWDKVKDIKTIRKVLS-IPQLNIVKKTEVQT  GGFSK  ESIL-SKR-  1083
WP_003107102  1053  LAN-GNIIKRSPIE  VNEET-GE-IVWDKTKDFGTVRKVLS-APQVNIVKKTEIQT  GGFSN  ETIL-SKG-  1115
WP_054279288  1057  YAD-GTIVKRENIE  Y-SKDGE-IAWNKEIDFATIRKILS-LSQVNIVKKTEEQT  GGLFD  NNIV-SKKk  1124
WP_049531101  1059  YAD-GTIVKRENIE  Y-SKDGE-IAWNKEKDFATIKKVLS-LPQVNIVKKVEEQT  GGLFD  NNIV-SKKK  1124
WP_049538452  1058  YAD-GTIVKRENIE  Y-SKDGE-IAWNKEKDFATIKKVLS-YPQVNIVKKVEEQT  GGLFD  NNIV-SKEK  1120
WP_049549711  1010  LAD-GTLMKRPVIE  TNTET-GE-VVWDKVKDFKTIRKVLS-YPQVNIVKKTEIQS  GAFSK  ESVL-SKG-  1072
WP_007896501  1056  LAD-GTLMKRPVIE  TNTET-GE-VVWDKVKDFKTIRKVLS-YPQVNIVKKTEIQS  GAFSK  ESVL-SKG-  1118
EFR44625      1057  YAD-GTIKKRENIE  Y-SKDGE-IAWNKEKDFATIKKVLS-LPQVNIVKKVEEQT  GGLFD  NNIV-SKKk  1123
WP_002897477  1056  YAD-GTIVKRENIE  Y-SNDGE-IAWNKEKDFATIKKVLS-YPQVNIVKKVEEQT  GGLFD  NNIV-SKEK  1119
WP_002906454  1057  YAD-GTIVKRENIE  Y-SKDGE-IAWNKEKDFATIKKVLS-LPQVNIVKKVEEQT  GGFSK  ESIL-PKG-  1119
WP_009729476
```

```
CQR24647         1047 LAD-GRVVEKPVIE ANEET-GE-IAWDKTKHFANVKKVLS-YPQVSIVKKVEEQT GGFSK ESIL-PKG- 1109
WP_000066813     1061 YAD-GTIVKRENIE Y-SKDCGE-IAWNKEKDFATVKKVLS-LPQVNIVKKREVQT GGFSK ESIL-PKG- 1123
WP_009754323     1057 YAD-GTIVKRENIE Y-SKDCGE-IAWNKEKDFVTIKKVLS-YPQVNIVKKREVQT GGFSK ESIL-PKG- 1119
WP_044674937     1049 YSKtGEVRIRPVIE VNKET-GE-IVWDKKSDFRTVRKVLS-YPQVNVKKVEMQT GGFSK ESIL-QHG- 1112
WP_044676715     1051 YSKKGEVRIRPVIE VNKET-GE-IVWDKKSDFRTVRKVLS-YPQVNVKKVEMQT GGFSK ESIL-QHG- 1114
WP_044680361     1049 YSKKGEVRIRPVIE VNKET-GE-IVWDKKSDFKTVRKVLS-YPQVNVKKVEMQT GGFSK ESIL-QHG- 1112
WP_044681799     1051 YSKKGEVRIRPVIE VNKET-GE-IVWDKKSDFKTVRKVLS-YPQVNVKKVEMQT GGFSK ESIL-QHG- 1114
WP_049533112     1051 FAD-GTVVERPDIE T-SED-GE-IAWNKQTDFKIVRKVLS-YPQVNIVKKTEVQT GGFSK PSPK-PKP- 1122
WP_029090905     1008 -KQ--------Q --NStGE-VKWNPEVDIAKLKRILN-FKQCNIVRKVEEQS HGLDR ETIY-PVEe 1061
WP_006506696     1039 -D---------- ------GK-LIWNP-DLINEIKKCFY-YKDCYCTTKLDQKS GALFK -TVL-SNDa 1084
AIT42264         1052 LAN-GEIRKRPLIE TNGET-GE-IVWDKGRDFATVRKVLS-MPQVNIVKKTEVQT GQLFN ESIL-PKR- 1114
WP_002440723     1042 ------LA --NPD-GE-IAWEKDKDLNTIRKVLS-SKQINIIKKAEEGK GRLFK ETIN-SRPs 1092
AKQ21048         1052 LAN-GEIRKRPLIE TNGET-GE-IVWDKGRDFATVRKVLS-MPQVNIVKKTEVQT GGFSK ESIL-PKG- 1114
WP_004636532     1043 -E---------P VNEET-GE-ILWDTERHLSTIKRVLS-WKQMNIVKVEKQK GQLWK ETIY-PKG- 1092
WP_002364836     1048 -E---------P RFTKD-GE-ILWSN-SYLKTIKKELN-YHQMNIVKKVEVQK GGFSK ESIK-PKG- 1098
WP_016631044     999  -E---------P RFTKD-GE-ILWSN-SYLKTIKKELN-YHQMNIVKKVEVQK GGFSK ESIK-PKG- 1049
EMS75795         783  -E---------Y SYDEN-GE-IFWDKARHIPQIKKVIS-SHQVNIVKKVEVQT GGFYK ETVN-PKG- 834
WP_002373311     1048 -E---------P RFTKD-SE-ILWSN-SYLKTIKKELN-YHQMNIVKKVEVQK GGFSK ESIK-PKG- 1098
WP_002378009     1048 -E---------P RFTKD-GE-ILWSN-SYLKTIKKELN-YHQMNIVKKVEVQK GGFSK ESIK-PKG- 1098
WP_002407324     1048 -E---------P RFTKD-GE-ILWSN-SYLKTIKKELN-YHQMNIVKKVEVQK GGFSK ESIK-PKG- 1098
WP_002413717     1048 -E---------P RFTKD-GE-ILWSN-SYLKTIKKELN-YHQMNIVKKVEVQK GGFSK ESIK-PKG- 1098
WP_010775580     1048 -E---------P RFTKD-GE-ILWSN-SYLKTIKKELN-YHQMNIVKKVEVQK GGFSK ESIK-PKG- 1098
WP_010818269     1048 -E---------P RFTKD-GE-ILWSN-SYLKTIKKELN-YHQMNIVKKVEVQK GGFSK ESIK-PKG- 1098
WP_010824395     1048 -E---------P RFTKD-GE-ILWSN-SYLKTIKKELN-YHQMNIVKKVEVQK GGFSK ESIK-PKG- 1098
WP_016622245     1048 -E---------P RFTKD-GE-ILWSN-SYLKTIKKELN-YHQMNIVKKVEVQK GGFSK ESIK-PKG- 1098
WP_033624816     1048 -E---------P RFTKD-GE-ILWSN-SYLKTIKKELN-YHQMNIVKKVEVQK GGFSK ESIK-PKG- 1098
WP_033625576     1048 -T---------P VCDEN-GE-IFWDKSKSIAQVKKVIN-HHHMNIVKKTEIQK GGFSK ETVE-PKK- 1100
WP_033789179     1048 -T---------P VCDEN-GE-IFWDKSKSIAQVKKVIN-HHHMNIVKKTEIQK GGFSK ETVE-PKK- 1100
WP_002310644     1049 -T---------P VCDEN-GE-IFWDKSKSIAQVKKVIN-HHHMNIVKKTEIQK GGFSK ETVE-PKK- 1100
WP_002312694     1050 -T---------P VCDEN-GE-IFWDKSKSIAQVKKVIN-HHHMNIVKKTEIQK GGFSK ETVE-PKK- 1101
WP_002314015     1050 -T---------P VCDEN-GE-IFWDKSKSIAQVKKVIN-HHHMNIVKKTEIQK GGFSK ETVE-PKK- 1101
WP_002320716     1050 -T---------P VCDEN-GE-IFWDKSKSIAQVKKVIN-HHHMNIVKKTEIQK GGFSK ETVE-PKK- 1101
WP_002330729     1050 -T---------P VCDEN-GE-IFWDKSKSIAQVKKVIN-HHHMNIVKKTEIQK GGFSK ETVE-PKK- 1101
WP_002335161     1050 -T---------P VCDEN-GE-IFWDKSKSIAQVKKVIN-HHHMNIVKKTEIQK GGFSK ETVE-PKK- 1101
WP_002345439     1050 -T---------P FCDEN-GE-IYWEKSHHLPRIKKVLS-SHQVNIVKKVEQQK GGFSK ETVN-SKE- 1101
WP_034867970     1040 -E---------P FCDEN-GE-IYWEKSHHLPRIKKVLS-SHQVNIVKKVEQQK GGFSK ETVN-SKE- 1091
WP_047937432     1050 -E---------P VCDEN-GE-IFWDKSIAQVKKVIN-HHHMNIVKKTEIQK GGFYK ETVE-PKK- 1101
WP_010720994     1040 -E---------P FCDEN-GE-IYWEKSHHLPRIKKVLS-MHQVNIVKKTEIQK GGFYK ETVN-SKE- 1091
WP_010733004     1038 -E---------P IINDD-GE-ILWMNQETIAQVIKTLG-MHQVNRVKKTEIQK GGFSK ESIQ-PKG- 1089
WP_023519017     1034 -E---------I ICDEQ-GE-VIWNKKRDLSTIKKTIG-AHQVNIVKKVEKQK GGFFN ETIN-SKA- 1085
WP_010770040     1046 -A---------V IIDEN-GE-ILWDK-KNIATVKKVMS-YPQMNIVKKPEIQT GSFFN ETIK-PKG- 1096
WP_048604708     1043 -K---------- IIDEN-GE-ILWNQ--KKIVTVKKVMN-YRQMNIVKKTEIQK GTFFN ETVN-SKE- 1093
WP_010750235     1045 -E---------Q FCDEN-GE-IFWDKRKHIQQIKKVIS-THQVNIVKKTEVQT GSFYK ETVN-TKE- 1094
WP_007209003     1038 -D---------- IINDD-GE-ILWMNQETIAQVIKTLG-MHQVNIVKKTEIQK GGFSK ESIQ-PKG- 1089
AII16583         1091 LAN-GEIRKRPLIE T---GE-VVWDP-EMISRIKKCFY-YKDCFVTKLEENN GSFFN ESIL-PKR- 1153
WP_029073316     1053 -D---------- T---GE-IVWDP-NVIDRIKKCFY-YKDCFVTKKLEENN GTFFN -TVR-PNDe 1099
WP_031589969     1053 -D---------- -----WDKARDLPTIKRYLY-RAQVNKVRKAERQT GFFSD -TVL-PNDt 1099
KDA45870         1035 YPF--------- -------WDKARDLPTIKRYLY-FAQVNKVRKAERQT GFFSD EMLV-PKS- 1078
WP_039099354     1044 -N---------GTTQ LVDEN-TEaVIWNKESGLAYLNKIYQ-FKKLIVTREVHENS GALFN QTIYaAKDd 1097
AKP02966         1063 -D---------R -DRNtGE-IIWNNVG-FRDKILKLIFN-YHQCNVTRKTEIKT GQFYD QTIYsPKNp 1118
WP_010991369     1045 -D---------R IIDEN-GE-ILWDK-KYLDTVKKVMS-YRQMNIVKKTEIQK GEFSK ATIK-PKG- 1095
WP_033838504     1045 -D---------R IIDEN-GE-ILWDK-KYLDTVKKVMS-YRQMNIVKKTEIQK GEFSK ATIK-PKG- 1095
EHN60060         1048 -D---------R IIDEN-GE-ILWDK-KYLDTVKKVMS-YRQMNIVKKTEIQK GEFSK ATIK-PKG- 1098
```

```
                                                       -continued

EFR89594           814  -D------- IIDEN-GE-ILWDK-KYLDTVKKVMS-YRQMNIVKKTEIQK GEFSK ATIK-PKG-   864
WP_038409211      1045  -N------- IIDKN-GE-ILWDN-RYLDTIKKVLS-YRQMNIVKKTEIQK GEFSN ATVN-PKG-  1095
EFR95520           664  -N------Q IIDKN-GE-ILWDN-RYLDTIKKVLS-YRQMNIVKKTEIQK GEFSN ATVN-PKG-   714
WP_003723650      1045  -E------- IIDEN-GE-ILWDK-KYLETIKKVLD-YRQMNIVKKTEIQK GEFSK ATIK-PKG-  1095
WP_003727705      1045  -E------- IIDEN-GE-ILWDK-KYLETIKKVLD-YRQMNIVKKTEIQK GEFSK ATIK-PKG-  1095
WP_003730785      1045  -R------- IIDEN-GE-ILWDK-KYLETIKKVLD-YRQLNIVKKTEIQK GEFSN VTPN-PKG-  1095
WP_003733029      1045  -D------- IIDEN-GE-ILWDK-KYLETKKVLG-YRQMNIVKKTEIQK GEFSK ATIK-PKG-  1095
WP_003739838      1045  -E------- IIDEN-GE-ILWDK-KYLETIKKVLD-YRQMNIVKKTEIQK GEFSN VTPN-PKG-  1095
WP_014601172      1045  -E------- IIDEN-GE-ILWDK-KYLETIKKVLD-YRQMNIVKKTEIQK GEFSK ATIK-PKG-  1095
WP_023548323      1045  -E------- IIDEN-GE-ILWDK-KYLETIKKVLN-YRQMNIVKKTEIQK GEFSK QNPK-PRG-  1095
WP_031665337      1045  -E------- IIDEN-GE-ILWDK-KYLETIKKVLG-YRQMNIVKKTEIQK GEFSN ATIK-PKG-  1095
WP_031669209      1045  -D------- IIDEN-GE-ILWDK-RYLETIKKVLS-YRQMNIVKKTEIQK GEFSN VTPN-PKG-  1095
WP_033920898      1045  -R------- IIDEN-GE-ILWDK-KYLETIKKVLN-YRQMNIVKKTEIQK GEFSN QNPK-PRG-  1095
AKI42028          1048  -E------- IIDEN-GE-ILWDK-KYLETIKKVLD-YRQMNIVKKTEIQK GEFSK ATIK-PKG-  1098
AKI50529          1048  -E------- IIDEN-GE-ILWDK-KYLETIKKVLD-YRQMNIVKKTEIQK GEFSK QNPK-PRG-  1098
EFR83390           493  -R------- IIDEN-GE-ILWDK-KYLETIKKVLD-YRQMNIVKKTEIQK GEFSK ATIK-PKG-   543
WP_046323366      1045  -D------- IIDEN-GE-ILWDK-KYLDTIKKVLN-YRQMNIVKKTEIQK GEFSN ATAN-PKG-  1095
AKE81011          1068  LAN-GEIRKRPLIE TNGET-GE-IVWDKGRDFATVRKVLS-MPQVNIVKKTEVQT GGFSK ESIL-PKR-  1130
CUO82355          1043  -D------- -----T-GE-VNWDP-DLINEIKKCFY-YKDCYCTTTKLDQKS GQMFN -TVL-PNDa  1088
WP_033162887      1085  -D------- -----T-GE-VNMWDP-AKIGKIKSCFY-YKDYYVTKKLEQNS GTLFN -TVL-PNDa  1089
AGZ01981          1052  LAN-GEIRKRPLIE TNGET-GE-IVWDKGRDFATVRKVLS-MPQVNIVKKTEVQT GGFSK ESIL-PKR-  1147
AKA60242          1052  LAN-GEIRKRPLIE TNGET-GE-IVWDKGRDFATVRKVLS-MPQVNIVKKTEVQT GGFSK ESIL-PKR-  1114
AKS40380          1056  LAN-GEIRKRPLIE TNGET-GE-IVWDKGRDFATVRKVLS-MPQVNIVKKTEVQT GGFSK ESIL-PKR-  1114
4UN5_B            1056  LAN-GEIRKRPLIE TNGET-GE-IVWDKGRDFATVRKVLS-MPQVNIVKKTEVQT GGFSK ESIL-PKR-  1118

WP_010922251      1115  -NSD KLIA---RKKDW-DPKKYGGPDSPTVAYSV-LVVAK--VE--KGKSKKLKSVKELLGITIME RSSFEK  1176
WP_010922251      1121  -DSD KLIPRKTkKV-YW-DTKKYGGPDSPTVAYSV-FVVAD--IE--KGRAKKLKTVKELVGISIME RSFFEE  1185
WP_045635197      1119  -NSD KLIPRKT-KDILL-DTTKYGGPDSPTVIAYSI-LLIAD--IE--KGRAKKLKTVKTLVGITIME RSSFEK  1183
5AXW_A             853  -EKN -LYKYYEeTGNYL---TKYSKKDNGPVIKKI-----------KYYGNKLNAHLDITDDYPNS -VKLSL   912
WP_009880683       799  -NSD KLIA---RKKDW-DPKKYGGPDSPTVAYSV-LVVAK--VE--KGKSKKLKSVKELVGITIME RSSFEK   860
WP_010922251      1115  -NSD KLIA---RKKDW-DPKKYGGPDSPTVAYSV-LVVAK--VE--KGKSKKLKSVKELLGITIME RSSFEK  1176
WP_011054416      1115  -NSD KLIA---RKKDW-DPKKYGGPDSPTVAYSV-LVVAK--VE--KGKSKKLKSVKELVGITIME RSSFEK  1176
WP_011284745      1115  -NSD KLIA---RKKDW-DPKKYGGPDSPTVAYSV-LVVAK--VE--KGKSKKLKSVKELLGITIME RSSFEK  1176
WP_011285506      1115  -NSD KLIA---RKKDW-DPKKYGGPDSPTVAYSV-LVVAK--VE--KGKSKKLKSVKELLGITIME RSSFEK  1176
WP_011527619      1115  -NSD KLIA---RKKDW-DPKKYGGPDSPTVAYSV-LVVAK--VE--KGKSKKLKSVKELLGITIME RSSFEK  1176
WP_012560673      1115  -NSD KLIA---RKKDW-DPKKYGGPDSPTVAYSV-LVVAK--VE--KGKSKKLKSVKELVGITIME RSSFEK  1176
WP_012566673      1115  -NSD KLIA---RKKDW-DPKKYGGPDSPTVAYSV-LVVAK--VE--KGKSKKLKSVKELVGITIME RSSFEK  1175
WP_014407541      1114  -NSD KLIA---RKKDW-DPKKYGGPDSPTVAYSV-LVVAK--VE--KGKSKKLKSVKELVGITIME RSSFEK  1175
WP_020905136      1115  -NSD KLIA---RKKDW-DPKKYGGPDSPTVAYSV-LVVAK--VE--KGKSKKLKSVKELVGITIME RSSFEK  1176
WP_023080005      1114  -NSD KLIA---RKKDW-DPKKYGGPDSPTVAYSV-LVVAK--VE--KGKSKKLKSVKELVGITIME RSSFEK  1175
WP_023610282      1115  -NSD KLIA---RKKDW-DPKKYGGPDSPTVAYSV-LVVAK--VE--KGKSKKLKSVKELVGITIME RSSFEK  1175
WP_030125963      1115  -NSD KLIA---RKKDW-DPKKYGGPDSPTVAYSV-LVVAK--VE--KGKSKKLKSVKELVGITIME RSSFEK  1176
WP_030126706      1115  -NSD KLIA---RKKDW-DPKKYGGPDSPTVAYSV-LVVAK--VE--KGKSKKLKSVKELVGITIME RSSFEK  1176
WP_031488318      1115  -NSD KLIA---RKKDW-DPKKYGGPDSPTVAYSV-LVVAK--VE--KGKSKKLKSVKELVGITIME RSSFEK  1176
WP_032460140      1115  -NSD KLIA---RKKDW-DPKKYGGPDSPTVAYSV-LVVAK--VE--KGKSKKLKSVKELVGITIME RSSFEK  1176
WP_032461047      1115  -NSD KLIA---RKKDW-DPKKYGGPDSPTVAYSV-LVVAK--VE--KGKSKKLKSVKELVGITIME RSSFEK  1176
WP_032462016      1115  -NSD KLIA---RKKDW-DPKKYGGPDSPTVAYSV-LVVAK--VE--KGKSKKLKSVKELVGITIME RSSFEK  1176
WP_032462936      1115  -NSD KLIA---RKKDW-DPKKYGGPDSPTVAYSV-LVVAK--VE--KGKSKKLKSVKELVGITIME RSSFEK  1176
WP_032464890      1115  -NSD KLIA---RKKDW-DPKKYGGPDSPTVAYSV-LVVAK--VE--KGKSKKLKSVKELVGITIME RSSFEK  1176
WP_033888930       940  -NSD KLIA---RKKDW-DPKKYGGPDSPTVAYSV-LVVAK--VE--KGKSKKLKSVKELVGITIME RSSFEK  1001
WP_038431314      1115  -NSD KLIA---RKKDW-DPKKYGGPDSPTVAYSV-LVVAK--VE--KGKSKKLKSVKELVGITIME RSSFEK  1176
WP_038432938      1114  -NSD KLIA---RKKDW-DPKKYGGPDSPTVAYSV-LVVAK--VE--KGKSKKLKSVKELVGITIME RSSFEK  1175
WP_038434062      1115  -NSD KLIA---RKKDW-DPKKYGGPDSPTVAYSV-LVVAK--VE--KGKSKKLKSVKELVGITIME RSSFEK  1176
BAQ51233          1026  -NSD KLIA---RKKDW-DPKKYGGPDSPTVAYSV-LVVAK--VE--KGKSKKLKSVKELVGITIME RSSFEK  1087
```

```
                         -continued
KGE60162       290  --NSD KLIA----RKKDW-DPKKYGGFDSPTVAYSV-LVVAK--VE--KGKSKKLKSVKELLGITIME RSSFEK   351
KGE60856        53  --NSD KLIA----RKKDW-DPKKYGGFDSPTVAYSV-LVVAK--VE--KGKSKKLKSVKELLGITIME RSSFEK   114
WP_002989955  1115  --NSD KLIA----RKKDW-DPKKYGGFDSPTVAYSV-LVVAK--VE--KGKSKKLKSVKELLGITIME RSSFEK  1176
WP_003030002  1094  --ESD KLIPRKT-KNSYW-NPKKYGGEDSPVVAYSI-LVFAD--VE--KGKAKKLKTVKELVGISIME KKRFEK  1158
WP_003065552  1122  --DSD KLIPRKTkKA-YW-DTKKYGGFDSPVVAYSV-FVVAD--VE--KGKAKKLKTVKELVGISIME RSFFEE  1186
WP_001040076  1113  --NSD KLIPRKT-KDIYL-DPKKYGGFDSPIVAYSV-LVVAD--IK--KGKAQKLKTVTELLGITIME RSKFEK  1185
WP_001040078  1121  --NSD KLIPRKT-KDIYL-DPKKYGGFDSPIVAYSV-LVVAD--IK--KGKAQKLKTVTELLGITIME RSRFEK  1177
WP_001040080  1113  --NSD KLIPRKT-KDIYL-DPKKYGGFDSPIVAYSV-LVVAD--IK--KGKAQKLKTVTELLGITIME RSRFEK  1177
WP_001040081  1113  --NSD KLIPRKT-KDIYL-DPKKYGGFDSPIVAYSV-LVVAD--IK--KGKAQKLKTVTELLGITIME RSRFEK  1177
WP_001040083  1113  --NSD KLIPRKT-KDIYL-DPKKYGGFDSPIVAYSV-LVVAD--IK--KGKAQKLKTVTELLGITIME RSRFEK  1177
WP_001040085  1113  --NSD KLIPRKT-KDIYL-DPKKYGGFDSPIVAYSV-LVVAD--IK--KGKAQKLKTVTELLGITIME RSRFEK  1177
WP_001040087  1113  --NSD KLIPRKT-KDIYL-DPKKYGGFDSPIVAYSV-LVVAD--IK--KGKAQKLKTVTELLGITIME RSRFEK  1177
WP_001040088  1113  --NSD KLIPRKT-KDIYL-DPKKYGGFDSPIVAYSV-LVVAD--IK--KGKAQKLKTVTELLGITIME RSRFEK  1177
WP_001040089  1113  --NSD KLIPRKT-KDIYL-DPKKYGGFDSPIVAYSV-LVVAD--IK--KGKAQKLKTVTELLGITIME RSRFEK  1177
WP_001040090  1113  --NSD KLIPRKT-KDIYL-DPKKYGGFDSPIVAYSV-LVVAD--IK--KGKAQKLKTVTELLGITIME RSRFEK  1177
WP_001040091  1113  --NSD KLIPRKT-KDIYL-DPKKYGGFDSPIVAYSV-LVVAD--IK--KGKAQKLKTVTELLGITIME RSRFEK  1177
WP_001040092  1113  --NSD KLIPRKT-KDIYL-DPKKYGGFDSPIVAYSV-LVVAD--IK--KGKAQKLKTVKELVGISIME RSRFEK  1177
WP_001040094  1113  --NSD KLIPRKT-KDIYL-DPKKYGGFDSPIVAYSV-LVVAD--IK--KGKAQKLKTVTELLGITIME RSRFEK  1177
WP_001040095  1113  --NSD KLIPRKT-KDIYL-DPKKYGGFDSPIVAYSV-LVVAD--IK--KGKAQKLKTVTELLGITIME RSRFEK  1177
WP_001040096  1113  --NSD KLIPRKT-KDIYL-DPKKYGGFDSPIVAYSV-LVVAD--IK--KGKAQKLKTVTELLGITIME RERFEK  1177
WP_001040097  1113  --NSD KLIPRKT-KDIYL-DPKKYGGFDSPIVAYSV-LVVAD--IK--KGKAQKLKTVTELLGITIME RSRFEK  1177
WP_001040098  1113  --NSD KLIPRKT-KDIYL-DPKKYGGFDSPIVAYSV-LVVAD--IK--KGKAQKLKTVTELLGITIME RSRFEK  1177
WP_001040099  1113  --NSD KLIPRKT-KDIYL-DPKKYGGFDSPIVAYSV-LVVAD--IK--KGKAQKLKTVTELLGITIME RSRFEK  1177
WP_001040100  1113  --NSD KLIPRKT-KDIYL-DPKKYGGFDSPIVAYSV-LVVAD--IK--KGKAQKLKTVTELLGITIME RSRFEK  1177
WP_001040104  1113  --NSD KLIPRKT-KDIYL-DPKKYGGFDSPIVAYSV-LVVAD--IK--KGKAQKLKTVTELLGITIME RSRFEK  1177
WP_001040105  1113  --NSD KLIPRKT-KDIYL-DPKKYGGFDSPIVAYSV-LVVAD--IK--KGKAQKLKTVTELLGITIME RFRFEK  1177
WP_001040106  1113  --NSD KLIPRKT-KDIYL-DPKKYGGFDSPIVAYSV-LVVAD--IK--KGKAQKLKTVTELLGITIME RSRFEK  1177
WP_001040107  1113  --NSD KLIPRKT-KDIYL-DPKKYGGFDSPIVAYSV-LVLAD--IK--KGKAQKLKTVTELLGITIME RFRFEK  1177
WP_001040108  1113  --NSD KLIPRKT-KDIYL-DPKKYGGFDSPIVAYSV-LVVAD--IK--KGKAQKLKTVTELLGITIME RFRFEK  1177
WP_001040109  1113  --NSD KLIPRKT-KDIYL-DPKKYGGFDSPIVAYSV-LVVAD--IK--KGKAQKLKTVTELLGITIME RERFEK  1177
WP_001040110  1113  --NSD KLIPRKT-KDIYL-DPKKYGGFDSPIVAYSV-LVVAD--IK--KGKAQKLKTVTELLGITIME RERFEK  1177
WP_015058523  1113  --NSD KLIPRKT-KDIYL-DPKKYGGFDSPIVAYSV-LVLAD--IK--KGKAQKLKTVTELLGITIME RSRFEK  1177
WP_017643650  1113  --NSD KLIPRKT-KDIYL-DPKKYGGFDSPIVAYSV-LVVAD--IK--KGKAQKLKTVTELLGITIME RSRFEK  1177
WP_017647151  1113  --NSD KLIPRKT-KDIYL-DPKKYGGFDSPIVAYSV-LVVAD--IK--KGKAQKLKTVTELLGITIME RSRFEK  1177
WP_017648376  1113  --NSD KLIPRKT-KDIYL-DPKKYGGFDSPIVAYSV-LVVAD--IK--KGKAQKLKTVTELLGITIME RSRFEK  1177
WP_017649527  1113  --NSD KLIPRKT-KDIYL-DPKKYGGFDSPIVAYSV-LVVAD--IK--KGKAQKLKTVTELLGITIME RSRFEK  1177
WP_017771611  1113  --NSD KLIPRKT-KDIYL-DPKKYGGFDSPIVAYSV-LVVAD--IK--KGKAQKLKTVTELLGITIME RSRFEK  1177
WP_017771984  1113  --NSD KLIPRKT-KDIYL-DPKKYGGFDSPIVAYSV-LVAAD--IK--KGKAQKLKTVTELLGITIME RSRFEK  1177
CFQ25032      1113  --NSD KLIPRKT-KDIYL-DPKKYGGFDSPIVAYSV-LVVAD--IK--KGKAQKLKTVTELLGITIME RSRFEK  1177
CFV16040      1113  --NSD KLIPRKT-KDIYL-DPKKYGGFDSPIVAYSV-LVVAD--IK--KGKAQKLKTVTELLGITIME RSRFEK  1177
KLJ37842      1113  --NSD KLIPRKT-KDIYL-DPKKYGGFDSPIVAYSV-LVVAD--IK--KGKAQKLKTVKELLGITIME RSRFEK  1177
KLJ72361      1127  --NSD KLIPRKT-KDIYL-DPKKYGGFDSPIVAYSV-LVVAD--IK--KGKAQKLKTVTELLGITIME RSRFEK  1191
KLL20707      1113  --NSD KLIPRKT-KDIYL-DPKKYGGFDSPIVAYSV-LVVAD--IK--KGKAQKLKTVTELLGITIME RSRFEK  1177
KLL42645      1113  --NSD KLIPRKT-KDIYL-DPKKYGGFDSPIVAYSV-LVVAD--IK--KGKAQKLKTVTELLGITIME RSRFEK  1177
WP_047207273  1113  --NSD KLIPRKT-KDIYL-DPKKYGGFDSPIVAYSV-LVVAD--IK--KGKAQKLKTVTELLGITIME RSRFEK  1177
WP_047209694  1113  --NSD KLIPRKT-KDIYL-DPKKYGGFDSPIVAYSV-LVVAD--IK--KGKAQKLKTVTELLGITIME RSRFEK  1177
WP_050198062  1113  --NSD KLIPRKT-KDIYL-DPKKYGGFDSPIVAYSV-LVVAD--IK--KGKAQKLKTVTELLGITIME RFRFEK  1177
WP_050201642  1113  --NSD KLIPRKT-KDIYL-DPKKYGGFDSPIVAYSV-LVVAD--IK--KGKAQKLKTVTELLGITIME RSRFEK  1177
WP_050204027  1113  --NSD KLIPRKT-KDIYL-DPKKYGGFDSPIVAYSV-LVVAD--IK--KGKAQKLKTVTELLGITIME RFRFEK  1177
WP_050881965  1113  --NSD KLIPRKT-KDIYL-DPKKYGGFDSPIVAYSV-LVVAD--IK--KGKAQKLKTVTELLGITIME RSRFEK  1177
WP_050886065  1113  --NSD KLIPRKT-KDIYL-DPKKYGGFDSPIVAYSV-LVLAD--IK--KGKAQKLKTVKELLGITIME RSRFEK  1177
AHN30376      1113  --NSD KLIPRKT-KDIYL-DPKKYGGFDSPIVAYSV-LVVAD--IK--KGKAQKLKTVTELLGITIME RERFEK  1177
EAO78426      1113  --NSD KLIPRKT-KDIYL-DPKKYGGFDSPIVAYSV-LVVAD--IK--KGKAQKLKTVTELLGITIME RSRFEK  1177
CCW42055      1113  --NSD KLIPRKT-KDIYL-DPKKYGGFDSPIVAYSV-LVVAD--IK--KGKAQKLKTVTELLGITIME RSRFEK  1177
```

```
                      -continued
WP_003041502   1123  --DSS  ENLVGVK-RNL---DPKKYGGYAGISNSYAV-LVKAI--IE--KGVKKKETMVLEFQGISLLD  RITFEK  1185
WP_037593752   1095  --ESD  KLIPRKT-KNSYW-NPKKYGGFDSPVVAYSI-LVFAD--VE--KGKSKKLLRKVQDMVGITIME  KKRFEK  1159
WP_049516684   1095  --ESD  KLIPRKT-KNSYW-NPKKYGGFDSPVVAYSI-LVFAD--VE--KGKSKKLLRKVQDMVGITIME  KKRFEK  1159
GAD46167       1094  --ESD  KLIPRKT-KNSYW-NPKKYGGFDSPVVAYSI-LVFAD--VE--KGKSKKLLRKVQDMVGITIME  KKRFEK  1158
WP_018363470   1126  --DSD  KLIPRKKV-LW--EPKKYGGFDSPVVAYSI-LVFAD--VE--KGKTKKLKTVKELVGISIME  RSFFEK  1190
WP_003043819   1124  --ESA  KLIP----RKKGW-DTRKYGGFDSPIVAYSI-LVVAK--VE--KGKAKKLKSVKVLVGITIME  KGSYEK  1185
WP_006269658   1094  --ESD  KLIPRKT-KNSYW-DPKKYGGFDSPIVAYSV-LVFAD--VE--KGKSKKLLRKVQDMVGITIME  KKRFEK  1158
WP_048800089   1114  --DSD  KLIARKTkEN-YW-DTKKYGGDSPTVAYSV-LVVAD--IK--KGKAKKLKTVKELVGISIME  RPFFEK  1178
WP_012767106   1114  --SFD  KLIS----RKHRF-ESSKYGGFGSPTVTYSV-LVVAKskVQ--DGKVKKIKTGKELIGMTLLD  KLVFEK  1177
WP_014612333   1114  --SFD  KLIS----RKHRF-ESSKYGGFGSPTVTYSV-LVVAKskVQ--DGKVKKIKTGKELIGITLLD  KLVFEK  1177
WP_015017095   1114  --SFD  KLIS----RKHRF-ESSKYGGFGSPTVTYSV-LVVAKskVQ--DGKVKKIKTGKELIGITLLD  KLVFEK  1177
WP_015057649   1114  --SFD  KLIS----RKHRF-ESSKYGGFGSPTVTYSV-LVVAKskVQ--DGKVKKIKTGKELIGITLLD  KLVFEK  1177
WP_048327215   1114  --SFD  KLIS----RKHRF-ESSKYGGFGSPTVTYSV-LVVAKckVQ--DGKVKKIKTGKELIGITLLD  KLVFEK  1177
WP_049519324   1114  --NSD  KLIS----RKHRF-ESSKYGGFGSPTVTYSV-LVVAKskVQ--DGKVKKIKTGKELIGITLLD  KLVFEK  1177
WP_012515931   1095  --NSD  KLIP----RKNNW-DTRKYGGFDSPTVAYSV-LVIAK--ME--KGKAKVLKPVKEMVGITIME  RTAFEE  1156
WP_021320964   1095  --NSD  KLIP----RKNNW-DTRKYGGFDSPTVAYSV-LVIAK--ME--KGKAKVLKPVKEMVGITIME  RIAFEE  1156
WP_037581760   1095  --NSD  KLIP----RKNNW-DTRKYGGFDSPTVAYSV-LVIAK--ME--KGKAKVLKPVKEMVGITIME  RIAFEE  1156
WP_004232481   1124  --DSD  KLIPRKTkKL-QW-ETQKYGGFDSPTVAYSV-LVVAD--VE--KGKTRKLKTVKELVGISIME  RSSFEE  1188
WP_009854540   1119  --DSD  KLIPRKKV-YW--DTKKYGGFDSPIVAYSI-FVVAD--VE--KGKAKKLKTVKELVGISIME  RSFFEE  1183
WP_012962174   1120  --DSD  KLIPRKKF-RW--DTPKYGGDSPNIIAYSV-FVIAD--VE--KGKSKKLKTVKELVGISIME  RSSFEE  1184
WP_039695303   1121  --DSD  KLIPRKKV-YW--DTKKYGGDSPTVAYSV-FVVAD--VE--KGKAKKLKTVKELVGISIME  RSFFEE  1185
WP_014334983   1124  --DSD  KLIPRKTkKV-YW-NTKKYGGFDSPTVAYSV-LVVAD--IE--KGKAKKLKTVKELVGISIME  RSFFEE  1188
WP_003092269   1115  --DSD  KLIA----RKKSW-DPKKYGGFDSPIIAYSV-LVVAK--IA--KGKTQKLKTIKELVGIKIME  QDEFEK  1176
AHY15608       1115  --DSD  KLIA----RKKSW-DPKKYGGFDSPIIAYSV-LVVAK--IA--KGKTQKLKTIKELVGIKIME  QDEFEK  1176
AHY17476       1115  --DSD  KLIA----RKKSW-DPKKYGGFDSPIIAYSV-LVVAK--IA--KGKTQKLKTIKELVGIKIME  QDEFEK  1176
ESR09100          1  -----  --------------------------------------ME  QDEFEK     8
AGM98575       1115  --DSD  KLIA----RKKSW-DPKKYGGFDSPIIAYSV-LVVAK--IA--KGKTQKLKTIKELVGIKIME  QDEFEK  1176
ALF27331       1094  --NSD  KLIPRKT-KKFYW-DTKKYGGFDSPIIAYSV-LVIAN--IE--GKKPKKKSTIIAISRME    RTIFEK  1158
WP_018372492   1109  --NN-  KLIP----RKKDW-SVDKYGGFGIEPAESYSLaIFYTD--IN--GKKPKKKSTIIAISRME  KKDYEK  1167
WP_045618028   1125  VVDAS  KLTPIKS-G---L-SPEKYGGYARPTIAYSV-LVIAD--IE--KGKAKKLKRIKEMVGITVQD  KKKFEA  1188
WP_045635197   1119  --NSD  KLIPRKT-KDILL-DTTKYGGFDSPVVAYSI-LLIAD--IE--KGKAKKLKTVKTLVGITIME  KAAFEE  1183
WP_002263549   1094  --NSD  KLIPRKT-KKFYW-DTKKYGGFDSPIVAYSI-LVIAD--IE--KGKSKKLKTVKALVGVTIME  KMTFER  1158
WP_002263887   1094  --NSD  KLIPRKT-KKFYW-DTKKYGGFDSPIVAYSI-LVIAD--IE--KGKSKKLKTVKALVGVTIME  KMTFER  1158
WP_002264920   1094  --NSD  KLIPRKT-KKFYW-DTKKYGGFDSPIVAYSI-LVIAD--IE--KGKSKKLKTVKALVGVTIME  KMTFER  1158
WP_002269043   1094  --NSD  KLIPRKT-KKFYW-DTKKYGGFDSPIVAYSI-LVIAD--IE--KGKSKKLKTVKALVGVTIME  KMTFER  1158
WP_002269448   1094  --NSD  KLIPRKT-KKFYW-DTKKYGGFDSPIVAYSI-LVIAD--IE--KGKSKKLKTVKALVGVTIME  KMTFER  1158
WP_002271977   1094  --NSD  KLIPRKT-KKFYW-DTKKYGGFDSPIVAYSI-LVIAD--IE--KGKSKKLKTVKALVGVTIME  KMTFER  1158
WP_002272766   1094  --NSD  KLIPRKT-KKFYW-DTKKYGGFDSPIVAYSI-LVIAD--IE--KGKSKKLKTVKALVGVTIME  KMTFER  1158
WP_002273241   1094  --NSD  KLIPRKT-KKFYW-DTKKYGGFDSPIVAYSI-LVIAD--IE--KGKSKKLKTVKALVGVTIME  KMTFER  1158
WP_002775430   1094  --NSD  KLIPRKT-KKFYW-DTKKYGGFDSPIVAYSI-LVIAD--IE--KGKSKKLKTVKALVGVTIME  KMTFER  1158
WP_002779025   1094  --NSD  KLIPRKT-KKFYW-DTKKYGGFDSPIVAYSI-LVIAD--IE--KGKSKKLKTVKALVGVTIME  KMTFER  1158
WP_002276448   1094  --NSD  KLIPRKT-KKFYW-DTKKYGGFDSPIVAYSI-LVIAD--IE--KGKSKKLKTVKALVGVTIME  KMTFER  1158
WP_002277050   1112  --PLE  KLVPLKK----AL-NPEKYGGYQKPTTAYPI-LLIVD--------TKQLIPISVMD        KKRFEQ  1166
WP_002773364   1094  --NSD  KLIPRKT-KKFYW-DTKKYGGFDSPIVAYSI-LVIAD--IE--KGKSKKLKTVKALVGVTIME  KMTFER  1158
WP_002279025   1094  --NSD  KLIPRKT-KKFYW-DTKKYGGFDSPIVAYSI-LVIAD--IE--KGKSKKLKTVKALVGVTIME  KMTFER  1158
WP_002279859   1094  --DSD  KLIPRKT-KKFYW-DTKKYGGFDSPIVAYSI-LVIAD--IE--KGKSKKLKTVKALVGVTIME  KMTFER  1158
WP_002280230   1094  --NSD  KLIPRKT-KKFYW-DTKKYGGFDSPIVAYSI-LVIAD--IE--KGKSKKLKTVKALVGVTIME  KMTFER  1158
WP_002281696   1094  --NSD  KLIPRKT-KKFYW-DTKKYGGFDSPIVAYSI-LVIAD--IE--KGKSKKLKTVKALVGVTIME  KMTFER  1158
WP_002282247   1112  --PLE  KLVPLKK----AL-NPEKYGGYQKPTTAYPI-LLIVD--------TKQLIPISVMD        KKRFEQ  1166
WP_002282906   1094  --NSD  KLIPRKT-KKFYW-DTKKYGGFDSPIVAYSI-LVIAD--IE--KGKSKKLKTVKALVGVTIME  KMTFER  1158
WP_002283846   1094  --NSD  KLIPRKT-KKFYW-DTKKYGGFDSPIVAYSI-LVIAD--IE--KGKSKKLKTVKALVGVTIME  KMTFER  1158
WP_002872255   1094  --DSD  KLIPRKT-KKFYW-DTKKYGGFDSPIVAYSI-LVIAD--IE--KGKSKKLKTVKALVGVTIME  KMTFER  1158
WP_002288990   1094  --NSY  KLIPRKT-KKFYW-DTKKYGGFDSPIVAYSI-LVIAD--IE--KGKSKKLKTVKALVGVTIME  KMTFER  1158
WP_002289641   1094  --NSD  KLIPRKT-KKFYW-DTKKYGGFDSPIVAYSI-LVIAD--IE--KGKSKKLKTVKALVGVTIME  KMTFER  1158
WP_002290427   1094  --DSD  KLIPRKT-KKFYW-DTKKYGGFDSPIVAYSI-LVIAD--IE--KGKSKKLKTVKALVGVTIME  KMTFER  1158
```

```
-continued

WP_002295753   1094  ---NSD  KLIPRKT-KKFYW---DTKKYGGFDSPIVAYSI--LVIAD---IE--KGKSKKLKTVKALVGVTIME   KMTFPER   1158
WP_002296423   1094  ---NSD  KLIPRKT-KKFYW---DTKKYGGFDSPIVAYSI--LVIAD---IE--KGKSKKLKTVKALVGVTIME   KMTFPER   1158
WP_002304487   1108  ---NSD  KLIPRKT-KKFYW---DTKKYGGFDSPIVAYSI--LVIAD---IE--KGKSKKLKTVKALVGVTIME   KMTFPER   1172
WP_002305844   1094  ---NSD  KLIPRKT-KKFYW---DTKKYGGFDSPIVAYSI--LVIAD---IE--KGKSKKLKTVKALVGVTIME   KMTFPER   1158
WP_002307203   1094  ---NSD  KLIPRKT-KKFYW---DTKKYGGFDSPIVAYSI--LVIAD---IE--KGKSKKLKTVKALVGVTIME   KMTFPER   1158
WP_002310390   1094  ---DSD  KLIPRKT-KKFYW---DTKKYGGFDSPIVAYSI--LVIAD---IE--KGKSKKLKTVKALVGVTIME   KMTFPER   1158
WP_002352408   1094  ---NSD  KLIPRKT-KKFYW---DTKKYGGFDSPIVAYSI--LVIAD---IE--KGKSKKLKTVKALVGVTIME   KMTFPER   1158
WP_012997688   1094  ---NSD  KLIPRKT-KKFYW---DTKKYGGFDSPIVAYSI--LVIAD---IE--KGKSKKLKTVKALVGVTIME   KMTFPER   1158
WP_014677909   1094  ---NSD  KLIPRKT-KKFYW---DTKKYGGFDSPIVAYSI--LVIAD---IE--KGKSKQLKTVKALVGVTIME   KMTFPER   1158
WP_019312892   1094  ---NSD  KLIPRKT-KKFYW---DTKKYGGFDSPIVAYSI--LVIAD---IE--KGKSKKLKTVKALVGVTIME   KMTFPER   1158
WP_019313659   1094  ---NSD  KLIPRKT-KKFYW---DTKKYGGFDSPIVAYSI--LVIAD---IE--KGKSKKLKTVKALVGVTIME   KMTFPER   1158
WP_019314093   1094  ---NSD  KLIPRKT-KKFYW---DTKKYGGFDSPIVAYSI--LVIAD---IE--KGKSKKLKTVKALVGVTIME   KMTFPER   1158
WP_019315370   1094  ---NSD  KLIPRKT-KKFYW---DTKKYGGFDSPIVAYSI--LVIAD---IE--KGKSKKLKTVKALVGVTIME   KMTFPER   1158
WP_019803776   1094  ---NSD  KLIPRKT-KKFYW---DTKKYGGFDSPIVAYSI--LVIAD---IE--KGKSKKLKTVKALVGVTIME   KMTFPER   1158
WP_019805234   1094  ---DSD  KLIPRKT-KKFYW---DTKKYGGFDSPIVAYSI--LVIAD---IE--KGKSKKLKTVKALVGVTIME   KMTFPER   1158
WP_024783594   1094  ---NSD  KLIPRKT-KKFYW---DTKKYGGFDSPIVAYSI--LVIAD---IE--KSKSKKLKTVKALVGVTIME   KMTFPER   1158
WP_024784288   1112  ---PLE  KLVPLKK----AL-NPEKYGGYQKPTTAYPI-LLIVD-------------TKQLIPISVMD         KKRFEQ   1166
WP_024784666   1094  ---NSD  KLIPRKT-KKFYW---DTKKYGGFDSPIVAYSI--LVIAD---IE--KGKSKKLKTVKALVGVTIME   KMTFPER   1158
WP_024784894   1094  ---NSD  KLIPRKT-KKFYW---DTKKYGGFDSPIVAYSI--LVIAD---IE--KGKAKRLKTVKTLVGITIME   KATFEK    1158
WP_024786433   1112  ---PLE  KLVPLKK----AL-NPEKYGGYQKPTTAYPI-LLIVD-------------TKQLIPISVMD         KKRFEQ   1166
WP_049473442   1094  ---NSD  KLIPRKT-KKFYW---DTKKYGGFDSPIVAYSI--LVIAD---IE--KGKSKKLKTVKALVGVTIME   KMTFPER   1158
WP_049474547   1094  ---NSD  KLIPRKT-KKFYW---DTKKYGGFDSPIVAYSI--LVIAD---IE--KGKSKKLKTVKALVGVTIME   KMTFPER   1158
EMC03581       1087  ---NSD  KLIPRKT-KDILW---DTTKYGGFDSPIVAYSI--LLIAD---IE--KGKAKKLKTVKTLVGITIME   KAAFEE    1151
WP_000428612   1122  ---NSD  KLIPRKT-KDILW---ETTKYGGFDSPIVAYSI--LLIAD---IE--KGKAKRLKTVKTLVGITIME   KVKFEA    1186
WP_000428613   1120  ---NSD  KLIPRKT-KNVQL--DTTKYGGFDSPVIAYSI--LLVAD---VE--KGKSQKTKSVKELVGITIME   QNEFEK    1184
WP_049523028   1115  ---DSD  KLIP----RKNNW-DPKKYGGENTPVKAYSV--LVVAK---VT--KGKGAKLKPVKAKRIKEMGIT   RTKFEA    1179
WP_003107102   1084  ---KSS  KLIP----RKNKW-rDTTKYGGENTPVKAYSV--LVVAK---VE--KGKAKKLKRIKEMVGITIQD   KKKFEA    1145
WP_054279288   1116  VVDAS   KLIPIKS-G--------L-SPEKYGGYARPTIAYSV--LVIAD---IE--KGKTKKLKRIKEMGITVQD   KKIFES    1178
WP_049531101   1125  VVDAS   KLIPIKS-G--------L-SPEKYGGYARPTIAYSV--LVIAD---IE--KGKTKKLKRIKEMVGITIQD  KKKFEA    1188
WP_049538452   1125  VVDAS   KLIPIKS-G--------L-SPEKYGGYARPTIAYSV--LVIAD---IE--KGKTKKLKRIKEMVGITIQD  KKIFES    1188
WP_049549711   1127  VVDAS   KLIPIKS-S--------L-SPEKYGGYARPTIAYSV--LVIAD---IE--KGKGKKLKRIKETVGITIQD  KKKFES    1190
WP_007896501   1121  ---NSD  KLIE---RKKGW-DPKKYGGFDSPNTAYSI--FVVAK---VA--KRKAQKLKTVKEIVGITIME      QAEYEK    1182
EFR44625       1073  ---NSD  KLIE---RKKGW-DPKKYGGFDSPNTAYSI--FVVAK---VA--KGRKLK--RELIGIPLAV        QAEYEK    1134
WP_002897477   1119  VVDAS   KLIPIKS-S--------L-SPEKYGGYARPTIAYSV--LVIAD---IEkgKGKAKKLKRIKEIVGITIQD  KAAFEE    1183
WP_002906454   1124  ---NSD  KLIPIKS-S--------L-SPEKYGGYARPTIAYSV--LVIAD---IEkgKGKAKKLKRIKETVGITIQD  KKKFES    1189
WP_009729476   1120  ---NSD  KLIPRKT-KDILW---DTTKYGGFDSPVIAYSI--LLIAD---IE--KGKAKKLKTVKTLVGITIME   KDAFEK    1184
CQR24647       1110  ---GSD  KLIARKT-KNNYL--STQKYGGFDSPTVAYSI--MFVAD---IE--KGKSKRLKTVKEMIGITIME    RSRFES    1174
WP_000066813   1124  ---NSD  KLIPRKT-KEIIW---DTTKYGGFDSPVIAYSI--LLIAD---VE--KGKAKKLKTVKTLVGITIME   KATFEK    1188
WP_009754323   1120  ---NSD  KLIPRKT-KDILW---DTTKYGGFDSPVIAYSI--LLIAD---VE--KGKAKKLKTVKTLVGITIME   KAAFEK    1184
WP_044674937   1113  ---DSD  KLIP----EKFYL--DTKKYGGFDSPIVAYSV--LLIAD---VE--KGKAKKLKRVKELIGITIME   RMAFEK    1177
WP_044676715   1115  ---DSD  KLIP----EKFYL--DTKKYGGFDSPIVAYSV--LLIAD---VE--KGKAKKLKRVKELIGITIME   RMAFEK    1179
WP_044680361   1113  ---DSD  KLIP----EKFYL--DTKKYGGFDSPIVAYSV--LLIAD---VE--KGKAKKLKRVKELIGITIME   RMAFEK    1177
WP_044681799   1115  ---DSD  KLIP----EKFYL--DTKKYGGFDSPIVAYSV--LLIAD---IE--KGKAKKLKRVKELIGITIME   RMAFEK    1179
WP_049533112   1123  ---DSS  ENLVGVK-RNL----DTAIYGGYAGISNSYAV--LVKAI---LIQ--KGVKKKETMVLEPQGISILD   RITFBK    1185
WP_029090905   1062  ---SSS  KTIP----LKKHL--DTAIYGGYTAVNVASYA--LQYTI-----VA--FK--KGRKLK--REIIGIPLAV  QTRIDN    1117
WP_006506696   1085  haDKG   AVVP----vNKNRS--DVHKYGGFDSG---LQYTI-----VA--IBgqKKKGKGKTELVKKLsGVPLHL  KAASIN    1149
AIT42264       1115  ---NSD  KLIA---RKKDW-DPKKYGGFDSPTVAYSV--LVVAK---VE--KGKSKKLKSVKELLGITIME      RSSFEK    1176
AKQ21048       1093  k-KTE   KRIP----IKNNL--DPNIYGGYIEEKMAYYI-----VA--NGKTKK----AIVGISIKD          KKDFEG    1149
WP_034440723   1115  ---DSS  KLIA---RKKDW-DPKKYGGFDSPIVAYSV--LVVAK---VE--KGKSKKLKSVKELLGITIME      RSSFEK    1176
WP_004636532   1093  ---DSS  KLIP----VKEGM-DPQKYGGLSQVSEAFAV-VIT----HE--KGKKKQLK--SDLISIPIVD       QKAYEQ    1150
WP_002364836   1099  ---PSN  KLIP----VKNGL-DPQKYGGFDSPVVAYTV--LF--T--HE--KGKK-KPL-IKQEILGITIME     KTRFEQ    1156
WP_016631044   1050  ---PSN  KLIP----VKNGL-DPQKYGGFDSPVVAYTV--LF--T--HE--KGKK-KPL-IKQEILGITIME     KTRFEQ    1107
EMS75795        835  ---KPD  KLIQ----RKAGW-DVSKYGGFGSPVVAVAV--AFI-------YE--KGKAR--KKAKAIEGITIMK   QSLFEQ     892
WP_002373311   1099  ---PSN  KLIP----VKNGL-DPQKYGGFDSPVVAYTV--LF--T--HE--KGK-KPL-IKQEILGITIME      KTRFEQ    1156
```

```
WP_002378009    1099  --PSN  KLIP----VKNGL-DPQKYGGFDSPIVAYTV-LF--T--HE--KGK-KPL-IKQEILGITIME  KTRFEQ  1156
WP_002407324    1099  --PSN  KLIP----VKNGL-DPQKYGGFDSPIVAYTV-LF--T--HE--KGK-KPL-IKQEILGITIME  KTRFEQ  1156
WP_002413717    1099  --PSN  KLIP----VKNGL-DPQKYGGFDSPIVAYTV-LF--T--HE--KGK-KPL-IKQEILGITIME  KTRFEQ  1156
WP_010775580    1101  --PSN  KLIP----VKNGL-DPQKYGGFDSPVVAYTV-LF--T--HE--KGK-KPL-IKQEILGITIME  KTRFEQ  1158
WP_010818269    1099  --PSN  KLIP----VKNGL-DPQKYGGFDSPIVAYTV-LF--T--HE--KGK-KPL-IKQEILGITIME  KTRFEQ  1156
WP_010824395    1099  --PSN  KLIP----VKNGL-DPQKYGGFDSPIVAYTV-LF--T--HE--KGK-KPL-IKQEILGITIME  KTRFEQ  1156
WP_016622645    1099  --PSN  KLIP----VKNGL-DPQKYGGFDSPIVAYTV-LF--T--HE--KGK-KPL-IKQEILGITIME  KTRFEQ  1156
WP_033624816    1099  --PSN  KLIP----VKNGL-DPQKYGGFDSPIVAYTV-LF--T--HE--KGK-KPL-IKQEILGITIME  KTRFEQ  1156
WP_033625576    1099  --PSN  KLIP----VKNGL-DPQKYGGFDSPIVAYTV-LF--T--HE--KGK-KPL-IKQEILGITIME  KTKFEQ  1156
WP_033789179    1099  --PSN  KLIP----VKNGL-DPQKYGGFDSPVVAYTV-LFT----HE--KGK-KPL-IKQEILGITIME  KTRFEQ  1156
WP_002310644    1101  --DSS  KLLP----RKNNW-DPAKYGGLGSPNVAYTV-AFT----YE--KGKAR--KRTNALEGITIME  REAFEQ  1158
WP_002312694    1102  --DSS  KLLP----RKNNW-DPAKYGGLGSPNVAYTV-AFT----YE--KGKAR--KRTNALEGITIME  REAFEQ  1159
WP_002314015    1102  --DSS  KLLP----RKNNW-DPAKYGGLGSPNVAYTV-AFT----YE--KGKAR--KRTNALEGITIME  REAFEQ  1159
WP_002320716    1102  --DSS  KLLP----RKNNW-DPAKYGGLGSPNVAYTV-AFT----YE--KGKAR--KRTNALEGITIME  REAFEQ  1159
WP_002330729    1101  --DSS  KLLP----RKNNW-DPAKYGGLGSPNVAYTV-AFT----YE--KGKAR--KRTNALEGITIME  REAFEQ  1158
WP_002335161    1102  --DSS  KLLP----RKNNW-DPAKYGGLGSPNVAYTV-AFT----YE--KGKAR--KRTNALEGITIME  REAFEQ  1159
WP_002345439    1102  --DSS  KLLP----RKNNW-DPTKYGGLGSPNVAYTV-AFT----YE--KGKAR--KRTNALEGITIME  REAFEQ  1159
WP_034867970    1092  --KPD  KLIE----RKNNW-DVTKYGGFGSPVIAYAI-AFV----YA--KGKTQ--KKTRAIEGITIME  QAAFEK  1149
WP_047937432    1102  --DSS  KLIE----RKNNW-DPAKYGGLGSPNVAYTV-AFT----YA--KGKAR--KRTNALEGITIME  REAFEQ  1159
WP_010720994    1092  --KPD  KLIE----RKNNW-DVTKYGGFGSPVIAYAI-AFV----YA--KGKTQ--KKTKAIEGITIME  QAAFEK  1149
WP_010737004    1092  --KPD  KLIE----RKNNW-DVTKYGGFGSPVIAYAI-AFV----YA--KGKTQ--KKTRAIEGITIME  QAAFEK  1149
WP_034700478    1092  --KPD  KLIE----RKNNW-DVTKYGGFGSPVIAYAI-AFV----YA--KGKTQ--KKTRAIEGITIME  QAAFEK  1149
WP_007209003    1090  --ESQ  KLIR----RKQQW-NTKKYGGFDSPVVAYAI---LLS---FD--KGK-RKARSFK-IVGITIQD  RESFEG  1147
WP_023519017    1086  --NPE  KLIE----RKASL-DPLKYGGYGSPLVAYTV-IFI----FE--KGKQK--KVTKGIEGITVME  QLRFEQ  1143
WP_010770040    1097  --DSD  KLIS----RKTNW-SPKLYGGFGDSPQVAYSV-VI--T--YE--KGK-KKVRA--KAIVGITIME  QSLFKK  1154
WP_048604708    1094  --DSD  KLIS----RKKEW-DTTKYGGFGDSPNVAYSV-VI--R--YE--KGK-TRKLV-KTIVGITIME  RAAFEK  1151
WP_010750235    1095  --KPD  KLIS----RKNNW-DVTKYGGFGDSPVVAYAV-VFT----YE--KGKNH--KKAKAIEGITIME  QALFEK  1152
AII16583        1154  --NSD  KLIA----RKKDW-DPKKYGGFGDSPTVAYSV-LVVAK--VE--KGKSKKLKSVKELLGITIME  RSSFEK  1215
WP_029073316    1100  hsEKG  AKVP----VNKLRS-NVHKYGGPEG--LKYSI--VNSFI-----IKgkKKKGKKVIEVNKLTGIPLMY  KNVDDE  1164
WP_031589969    1100  nsDKD  ATVP----VNKYRS-NVNKYGFSG--VNSFI-----VA--IKgkKKKGKKVIEVNKLTGIPLMY  KNADEE  1138
KDA45870        1079  --DSG  KLLP----RKEGL-DPVKYGGYAKAVESYAV-LIITAD-eVK--KGKTKKVKT---LVNIPIID  SKKYEA  1170
WP_039099354    1098  k-ASG  QLIPAKQdRPTAL----YGGYSGKTVAYMC---IVR---KInkKGDLYKVCGVETSWLAQLKQ  KKAFLK  1172
AKP02966        1119  k---   KLIA----QKKDM-DPNIYGGSDDNKSSIT--IVK--ID---NNKIKYVA--IPIRLIN  ----DK  -
WP_010991369    1096  --NSS  KLIS----RKTNW-DPMKYGGLDSPNMAYAV-VI--E--YA--KGK-NKLVFEKKIRVTIME  RKAFEK  1154
WP_033838504    1096  --NSS  KLIS----RKTNW-DPMKYGGLDSPNMAYAV-VI--E--YA--KGK-NKLVFEKKIRVTIME  RKAFEK  1154
WP_033736060    1099  --NSS  KLIS----RKTNW-DPMKYGGLDSPNMAYAV-VI--E--YA--KGK-NKLVFEKKIRVTIME  RKAFEK  1157
EFR89594         865  --NSS  KLIS----RKTNW-DPMKYGGLDSPNMAYAV-VI--E--YA--KGK-NKLVFEKKIRVTIME  RKAFEK   923
WP_038409211    1096  --NSS  KLIS----RKADW-NPIKYGGFDGSNMAYSI-VI--E--YE--KRK-KKTVIKKELIQINIME  RVAFEK  1154
EFR95520         715  --NSS  KLIS----RKADW-NPIKYGGFDGSNMAYSI-VI--E--YE--KRK-KKTVIKKELIQINIME  RVAFEK   773
WP_003723650    1096  --NSS  KLIS----RKENW-DPMKYGGLDSPNMAYAV-II--E--HA--KGK-KKIVIEKKLIQINIME  RKMFEK  1154
WP_003727705    1096  --NSS  KLIS----RKENW-DPMKYGGLDSPNMAYAV-II--E--HA--KGK-KKIVIEKKLIQINIME  RKMFEK  1154
WP_003730785    1096  --NSS  KLIS----RKTNW-DPMKYGGLDSPNMAYAV-VI--E--YA--KGK-NKLVFEKKIRVTIME  RKAFEK  1154
WP_003733029    1096  --NSS  KLIP----RKKDW-DPIKYGGFDGSKMAYAI-II--E--YE--KQK-RKVFEKKIRITIME  REAFEK  1154
WP_003739838    1096  --NSS  KLIP----RKENW-DPMKYGGLDSPNMAYAV-II--E--HA--KGK-KKLIPEKKIRITIME  RKMFEK  1154
WP_014601172    1096  --NSS  KLIP----RKENW-DPMKYGGLDSPNMAYAV-II--E--HA--KGK-KKLIPEKKIRITIME  RKMFEK  1154
WP_023548323    1096  --DSS  KLIP----KKTNL-NPIKYGGFDGSNMAYAI-II--E--HE--KRK-KKVTIEKKLIQINIME  RKAFEK  1154
WP_031665337    1096  --NSS  KLIP----RKENW-DPMKYGGLDSPNMAYAV-II--E--HA--KGK-KKLIPEKKIRITIME  RKMFEK  1154
WP_031669209    1096  --KSN  KLIP----KKTNL-NPIKYGGFDGSNMAYAI-II--E--HE--KRK-KKVTIEKKLIQINIME  RKAFEK  1154
WP_033920898    1099  --DSS  KLIP----RKTNL-NPIKYGGFDGSNMAYAI-II--E--HA--KGK-KKRK-KKVTIEKKLIQINIME  RKMFEK  1157
AKI42028        1099  --DSS  KLIP----RKTNL-NPIKYGGFDGSNMAYAI-II--E--HA--KGK-KKRK-KKVTIEKKLIQINIME  REAFEK  1157
AKI50529         544  --KSN  KLIP----RKADW-DPIKYGGFDGSNMAYAI-VI--E--HE--KRK-KKVTIEKKLIQINIME  RKMFEK   602
EFR83390        1096  --NSS  KLIP----RKENW-DPMKYGGLDSPNMAYAV-II--E--HA--KGK-KKRK-KKVIVIEKKLIQINIME  RKMFEK  1154
WP_046323266    1096  --NSS  KLIA----RKADW-DPIKYGGFDGSNMAYAI-VI--E--HE--KRK-KKVTIEKKLIQINIME  RTAFEK  1154
AKE81011        1131  --NSD  KLIA----RKKDW-DPKKYGGFGDSPTVAYSV-LVVAK--VE--KGKSKKLKSVKELGITIME  RSSFEK  1192
```

```
                                                           -continued

CUO82355            1089  hsAKG  AVIP---VNKNRK-DVNKYGGFSG--LQYVI----AA--IEgtKKKGKKLVKVRKLSGIPLYL     KQADIK     1153
WP_033162887        1090  hsEKG  ATVP---INKYRA-DVHKYGGFGN--VQSII----VA--IEgkKKKGKKLIDVRKLTSIPLHL    KNAPVE     1154
AGZ01981            1148  --NSD  KLIA----RKKDW-DPKKYGGFDSPTVAYSV-LVVAK--VE--KGKSKKLKSVKELLGITIME   RSSFEK     1209
AKA60242            1115  --NSD  KLIA----RKKDW-DPKKYGGFDSPTVAYSV-LVVAK--VE--KGKSKKLKSVKELLGITIME   RSSFEK     1176
AKS40380            1115  --NSD  KLIA----RKKDW-DPKKYGGFDSPTVAYSV-LVVAK--VE--KGKSKKLKSVKELLGITIME   RSSFEK     1176
4UN5_B              1119  --NSD  KLIA----RKKDW-DPKKYGGFDSPTVAYSV-LVVAK--VE--KGKSKKLKSVKELLGITIME   RSSFEK     1180

WP_010922251        1177  NPI---DFLE---AKGYKE--V-KKDLIIK---LPKYSLFE---LENGRKRMLAS   -GELQKGNELALPSKYVNFLYLA     1239
WP_039695303        1186  NPV---EFLE---NKGYHN--I-REDKLIK---LPKYSLFE---FEGGRRRLLAS   ASELQKGNEMVLPGYLVELLYHA     1248
WP_045635197        1184  NPI---TFLE---NKGYHN--V-RKENILC---LPKYSLFE---LENGRRRLLAS   AKELQKGNEIVLPVYLTTLLYHS     1246
5AXW_A               913  KPYIfdVYLD--NGVYKFvtV-KNLDVIK---KENYYE---VNSKAYEEAKK      -KKISNQAEFIASFYNNDLIKIN      978
WP_009880683         861  DPV---DFLE---AKGYKE--V-RKDLIIK---LPKYSLFE---LENGRKRMLAS   -GELQKGNELALPSKYVNFLYLA      923
WP_010922251        1177  NPI---DFLE---AKGYKE--V-KKDLIIK---LPKYSLFE---LENGRKRMLAS   -GELQKGNELALPSKYVNFLYLA     1239
WP_011054416        1177  DPI---DFLE---AKGYKE--V-KKDLIVK---LPKYSLFE---LENGRKRMLAS   -GELQKGNELALPSKYVNFLYLA     1239
WP_011284745        1177  NPI---DFLE---AKGYKE--V-KKDLIIK---LPKYSLFE---LENGRKRMLAS   -GELQKGNELALPSKYVNFLYLA     1239
WP_011285506        1177  NPI---DFLE---AKGYKE--V-KKDLIIK---LPKYSLFE---LENGRKRMLAS   -GELQKGNELALPSKYVNFLYLA     1239
WP_011527619        1177  NPI---DFLE---AKGYKE--V-KKDLIIK---LPKYSLFE---LENGRKRMLAS   -GELQKGNELALPSKYVNFLYLA     1239
WP_012560673        1176  NPI---DFLE---AKGYKE--V-KKDLIIK---LPKYSLFE---LENGRKRMLAS   -GELQKGNELALPSKYVNFLYLA     1238
WP_014407541        1176  NPI---DFLE---AKGYKE--V-KKDLIIK---LPKYSLFE---LENGRKRMLAS   -GELQKGNELALPSKYVNFLYLA     1238
WP_020905136        1176  NPI---DFLE---AKGYKE--V-KKDLIIK---LPKYSLFE---LENGRKRMLAS   -GELQKGNELALPSKYVNFLYLA     1238
WP_023080005        1177  NPI---DFLE---AKGYKE--V-KKDLIIK---LPKYSLFE---LENGRKRMLAS   -GELQKGNELALPSKYVNFLYLA     1239
WP_023610282        1177  NPI---DFLE---AKGYKE--V-KKDLIIK---LPKYSLFE---LENGRKRMLAS   -GELQKGNELALPSKYVNFLYLA     1239
WP_030125963        1177  NPI---DFLE---AKGYKE--V-KKDLIIK---LPKYSLFE---LENGRKRMLAS   -GELQKGNELALPSKYVNFLYLA     1239
WP_031270670        1176  NPI---DFLE---AKGYKE--V-KKDLIIK---LPKYSLFE---LENGRKRMLAS   -GELQKGNELALPSKYVNFLYLA     1238
WP_031488318        1177  NPI---DFLE---AKGYKE--V-KKDLIIK---LPKYSLFE---LENGRKRMLAS   -GELQKGNELALPSKYVNFLYLA     1239
WP_032460140        1177  DPV---DFLE---AKGYKE--V-KKDLIIK---LPKYSLFE---LENGRKRMLAS   -GELQKGNELALPSKYVNFLYLA     1239
WP_032461047        1177  NPI---DFLE---AKGYKE--V-KKDLIIK---LPKYSLFE---LENGRKRMLAS   -GELQKGNELALPSKYVNFLYLA     1239
WP_032462016        1177  NPI---DFLE---AKGYKE--V-KKDLIIK---LPKYSLFE---LENGRKRMLAS   -GELQKGNELALPSKYVNFLYLA     1239
WP_032462936        1177  NPI---DFLE---AKGYKE--V-KKDLIIK---LPKYSLFE---LENGRKRMLAS   -GELQKGNELALPSKYVNFLYLA     1239
WP_032464890        1177  NPI---DFLE---AKGYKE--V-RKDLIIK---LPKYSLFE---LENGRKRMLAS   -GELQKGNELALPSKYVNFLYLA     1239
WP_033888930        1002  HPV---DFLE---QRGYRN--V-RLEKIIK---LPKYSLFE---LENKRRRLLAS   ARELQKGNELVIPQRFTTLLYHS     1064
WP_038431314        1177  NPV---EFLE---NKGYHN--I-REDKLIK---LPKYSLFE---FEGGKRRLLAS   ASELQKGNEMVIPGHLVKLLYHA     1239
WP_038432938        1176  NPI---DFLE---AKGYKE--V-KKDLIIK---LPKYSLFE---LENGRKRMLAS   -GELQKGNELALPSKYVNFLYLA     1238
WP_038434062        1177  NPI---DFLE---AKGYKE--V-KKDLIIK---LPKYSLFE---LENGRKRMLAS   -GELQKGNELALPSKYVNFLYLA     1239
BAQ51233            1088  NPI---DFLE---AKGYKE--V-KKDLIIK---LPKYSLFE---LENGRKRMLAS   -GELQKGNELALPSKYVNFLYLA     1150
KGE60162             352  DPI---DFLE---AKGYKE--V-KKDLIIK---LPKYSLFE---LENGRKRMLAS   -GELQKGNELALPSKYVNFLYLA      414
KGE60856             115  DPI---DFLE---AKGYKE--V-RKDLIIK---LPKYSLFE---LENGRKRMLAS   -GELQKGNELALPSKYVNFLYLA      177
WP_002989955        1177  NPI---DFLE---AKGYKE--V-RKDLIIK---LPKYSLFE---LENGRKRMLAS   -GELQKGNELALPSKYVNFLYLA     1239
WP_003030002        1159  NPV---EFLE---NKGYHN--V-REDKLIK---LPKYSLFE---LENKRRRLLAS   -GELQKGNELALPSKYVNFLYLA     1221
WP_003065552        1187  NPS---AFLE---SKGYLN--I-RTDKLII---LPKYSLFE---FEGGKRRLLAS   ASELQKGNEMVIPGHLVKLLYHA     1249
WP_001040076        1186  NPS---AFLE---SKGYLN--I-RDDKLMI---LPKYSLFE---LENGRRRLLAS   AGELQKGNELALPTQFMKFLYLA     1248
WP_001040078        1178  NPS---AFLE---SKGYLN--I-RADKLII---LPKYSLFE---LENGRRRLLAS   AGELQKGNELALPTQFMKFLYLA     1240
WP_001040080        1178  NPS---AFLE---SKGYLN--I-RADKLII---LPKYSLFE---LENGRRRLLAS   AGETIDRLQKGNELALPTQFMKFLYLA 1240
WP_001040081        1178  NPS---AFLE---SKGYLN--I-RADKLII---LPKYSLFE---LENGRRRLLAS   AGELQKGNELALPTQFMKFLYLA     1240
WP_001040083        1178  NPS---AFLE---SKGYLN--I-RADKLII---LPKYSLFE---LENGRRRLLAS   AGELQKGNELALPTQFMKFLYLA     1240
WP_001040085        1178  NPS---AFLE---SKGYLN--I-RDDKLMI---LPKYSLFE---LENGRRRLLAS   AGELQKGNELALPTQFMKFLYLA     1240
WP_001040087        1178  NPS---AFLE---SKGYLN--I-RADKLII---LPKYSLFE---LENGRRRLLAS   AGELQKGNELALPTQFMKFLYLA     1240
WP_001040088        1178  NPS---AFLE---SKGYLN--I-RDDKLMI---LPKYSLFE---LENGRRRLLAS   AGELQKGNELALPTQFMKFLYLA     1240
WP_001040089        1178  NPS---AFLE---SKGYLN--I-RADKLII---LPKYSLFE---LENGRRRLLAS   AGELQKGNELALPTQFMKFLYLA     1240
WP_001040090        1178  NPS---AFLE---SKGYLN--I-RDDKLMI---LPKYSLFE---LENGRRRLLAS   AGELQKGNELALPTQYMKFLYLA     1240
WP_001040091        1178  NPS---AFLE---SKGYLN--I-RTDKLII---LPKYSLFE---LENGRRRLLAS   AGELQKGNELALPTQFMKFLYLA     1240
WP_001040092        1178  NPS---AFLE---SKGYLN--I-RDDKLMI---LPKYSLFE---LENGRRRLLAS   AGELQKGNELALPTQYMKFLYLA     1240
WP_001040094        1178  NPS---AFLE---SKGYLN--I-RDDKLMI---LPKYSLFE---LENGRRRLLAS   AGELQKGNELALPTQFMKFLYLA     1240
```

```
                          -continued
WP_001040095   1178  NPS----AFLE---SKGYLN--I-RTDKLII--LPKYSLFE--LENGRRRLLAS   AGELQKGNELALPTQYMKFLYLA   1240
WP_001040096   1178  NPS----AFLE---SKGYLN--I-RTDKLII--LPKYSLFE--LENGRRRLLAS   AGELQKGNELALPTQYMKFLYLA   1240
WP_001040097   1178  NPS----AFLE---SKGYLN--I-RDDKLII--LPKYSLFE--LENGRRRLLAS   ADELQKGNELALPTQFMKFLYLA   1240
WP_001040098   1178  NPS----AFLE---SKGYLN--I-RDDKLMI--LPKYSLFE--LENGRRRLLAS   AGELQKGNELALPTQFMKFLYLA   1240
WP_001040099   1178  NPS----AFLE---SKGYLD--I-RDDKLMI--LPKYSLFE--LENGRRRLLAS   AGELQKGNELALPTQFMKFLYLA   1240
WP_001040100   1178  NPS----AFLE---SKGYLN--I-RDDKLMI--LPKYSLFE--LENGRRRLLAS   AGELQKGNELALPTQFMKFLYLA   1240
WP_001040104   1178  NPS----AFLE---SKGYLN--I-RADKLII--LPKYSLFE--LENGRRRLLAS   AGELQKGNELALPTQFMKFLYLA   1240
WP_001040105   1178  NPS----AFLE---SKGYLN--I-RDDKLMI--LPKYSLFE--LENGRRRLLAS   AGELQKGNELALPTQYMKFLYLA   1240
WP_001040106   1178  NPS----AFLE---SKGYLN--I-RDDKLMI--LPKYSLFE--LENGRRRLLAS   AGELQKGNELALPTQYMKFLYLA   1240
WP_001040107   1178  NPS----AFLE---SKGYLN--I-RDDKLMI--LPKYSLFE--LENGRRRLLAS   AGELQKGNELALPTQYMKFLYLA   1240
WP_001040108   1178  NPS----AFLE---SKGYLN--I-RDDKLMI--LPKYSLFE--LENGRRRLLAS   AGELQKGNELALPTQYMKFLYLA   1240
WP_001040109   1178  NPS----AFLE---SKGYLN--I-RDDKLMI--LPKYSLFE--LENGRRRLLAS   AGELQKGNELALPTQYMKFLYLA   1240
WP_001040110   1178  NPS----AFLE---SKGYLN--I-RDDKLMI--LPKYSLFE--LENGRRRLLAS   AGELQKGNELALPTQYMKFLYLA   1240
WP_015058523   1178  NPS----AFLE---SKGYLN--I-RTDKLII--LPKYSLFE--LENGRRRLLAS   AGELQKGNELALPTQYMKFLYLA   1240
WP_017643650   1178  NPS----AFLE---SKGYLN--I-RDDKLMI--LPKYSLFE--LENGRRRLLAS   AGELQKGNELALPTQFMKFLYLA   1240
WP_017647151   1178  NPS----AFLE---SKGYLN--I-RDDKLMI--LPKYSLFE--LENGRRRLLAS   AGELQKGNELALPTQFMKFLYLA   1240
WP_017648376   1178  NPS----AFLE---SKGYLN--I-RDDKLMI--LPKYSLFE--LENGRRRLLAS   AGELQKGNELALPTQFMKFLYLA   1240
WP_017649527   1178  NPS----AFLE---SKGYLN--I-RADKLII--LPKYSLFE--LENGRRRLLAS   AGELQKGNELALPTQYMKFLYLA   1240
WP_017771611   1178  NPS----AFLE---SKGYLN--I-RDDKLMI--LPKYSLFE--LENGRRRLLAS   AGELQKGNELALPTQFMKFLYLA   1240
WP_017771984   1178  NPS----AFLE---SKGYLN--I-RADKLII--LPKYSLFE--LENGRRRLLAS   AGELQKGNELALPTQFMKFLYLA   1240
CFQ25032       1192  NPS----AFLE---SKGYLN--I-RADKLII--LPKYSLFE--LENGRRRLLAS   AGELQKGNELALPTQFMKFLYLA   1254
CFV16040       1178  NPS----AFLE---SKGYLN--I-RADKLII--LPKYSLFE--LENGRRRLLAS   AGELQKGNELALPTQYMKFLYLA   1240
KLJ37842       1178  NPS----AFLE---SKGYLN--I-RADKLII--LPKYSLFE--LENGRRRLLAS   AGELQKGNELALPTQYMKFLYLA   1240
KLJ72361       1178  NPS----AFLE---SKGYLN--I-RADKLII--LPKYSLFE--LENGRRRLLAS   AGELQKGNELALPTQYMKFLYLA   1240
KLL20707       1178  NPS----AFLE---SKGYLN--I-RADKLII--LPKYSLFE--LENGRRRLLAS   AGELQKGNELALPTQFMKFLYLA   1240
KLL42645       1178  NPS----AFLE---SKGYLN--I-RDDKLMI--LPKYSLFE--LENGRRRLLAS   AGELQKGNELALPTQFMKFLYLA   1240
WP_047207273   1178  NPS----AFLE---SKGYLN--I-RADKLII--LPKYSLFE--LENGRRRLLAS   AGELQKGNELALPTQYMKFLYLA   1240
WP_047209694   1178  NPS----AFLE---SKGYLN--I-RADKLII--LPKYSLFE--LENGRRRLLAS   AGELQKGNELALPTQYMKFLYLA   1240
WP_050198062   1178  NPS----AFLE---SKGYLN--I-RADKLII--LPKYSLFE--LENGRRRLLAS   AGELQKGNELALPTQFMKFLYLA   1240
WP_050201642   1178  NPS----AFLE---SKGYLN--I-RADKLII--LPKYSLFE--LENGRRRLLAS   AGELQKGNELALPTQFMKFLYLA   1240
WP_050204027   1178  NPS----AFLE---SKGYLN--I-RDDKLMI--LPKYSLFE--LENGRRRLLAS   AGELQKGNELALPTQYMKFLYLA   1240
WP_050881965   1178  NLS----AFLE---SKGYLN--I-RADKLII--LPKYSLFE--LENGRRRLLAS   AGELQKGNELALPTQYMKFLYLA   1240
WP_050886065   1178  NPS----AFLE---SKGYLN--I-RADKLII--LPKYSLFE--LENGRRRLLAS   AGELQKGNELALPTQYMKFLYLA   1240
AHN30376       1178  NPS----AFLE---SKGYLN--I-RTDKLII--LPKYSLFE--LENGRRRLLAS   AGELQKGNELALPTQYMKFLYLA   1240
EAO78426       1178  NPS----AFLE---SKGYLN--I-RADKLII--LPKYSLFE--LENGRRRLLAS   AGELQKGNELALPTQFMKFLYLA   1240
CCW42055       1186  DKR----AFLL---GKGYKD--I-K--KIIE--LPKYSLFE--LKDGSRRLLAS   RGEIHKGNELFVPQKFTTLLYHA   1253
WP_003041502   1160  NPV----DFLE---QRGYRN--V-RLEKIIK--LPKYSLFE--LENKRRRLLAS   ARELQKGNELVIPQRFTTLLYHS   1222
WP_037593752   1160  NPV----DFLE---QRGYRN--V-RLEKIIK--LPKYSLFE--LENKRRRLLAS   ARELQKGNELVIPQRFTTLLYHS   1222
WP_049516684   1159  HPV----DFLE---QRGYRN--V-RLEKIIK--LPKYSLFE--LENKRRRLLAS   ARELQKGNELVIPQRFTTLLYHS   1221
GAD46167       1191  NPV----EFLK---NKGYQN--V-QEDKLME--LPKYSLFE--LEKGGRRLLAS   ATELQKGNEIMLSAHLVALLYHA   1253
WP_018363470   1186  DPI----GFLE---AKGYKD--I-KKELIFK--LPKYSLFE--LENGRRRMLAS   --ELQKANELVLPQHLVRLLYYT   1248
WP_003043819   1159  NPV----DFLE---QRGYRN--V-RLEKIIK--LPKYSLFE--LENKRRRLLAS   AKELQKGNELVIPQRFTTLLYHS   1221
WP_006269658   1179  NPI----MFLE---SKGYRN--I-QKDKLIK--LPKYSLFE--LENKRRRLLAS   AVELQKGNEMVLPQYLNNLLYHA   1241
WP_048800889   1178  NPL----DFLE---DKGYGN--V-QIDKCIK--LPKYSLFE--LPGGRRRMLAS   RGDLQKANEMFLPAKLVTLLY--   1245
WP_012767106   1178  NPL----KFIE---DKGYGN--V-QIDKCIK--LPKYSLFE--LFENGTRRMLAS   FENGTRRMLAS   RGDLQKANEMFLPAKLVTLLY-- 1245
WP_014612333   1178  NPL----KFIE---DKGYGN--V-QIDKCIK--LPKYSLFE--FENGTRRMLAS   RGDLQKANEMFLPAKLVTLLY--   1245
WP_015017095   1178  NPL----KFIE---DKGYGN--V-QIDKCIK--LPKYSLFE--FENGTRRMLAS   RGDLQKANEMFLPAKLVTLLY--   1245
WP_015057649   1178  NPL----KFIE---DKGYGN--V-QIDKCIK--LPKYSLFE--FENGTRRMLAS   RGDLQKANEMFLPAKLVTLLY--   1245
WP_048272215   1178  NPL----KFIE---DKGYGN--V-QIDKCIK--LPKYSLFE--FENGTRRMLAS   RGDLQKANEMFLPAKLVTLLY--   1245
WP_049519324   1157  NPV----VFLE---ARGYRE--I-QEHLIIK--LPKYSLFE--LENGRRRLLAS   -SELQKGNELFLPVDYMTFLYLA   1219
WP_012515931   1157  NPV----VFLE---AKGYRE--I-QEHLIIK--LPKYSLFE--LENGRRRLLAS   -SELQKGNELFLPVDYMTFLYLA   1219
WP_021320964   1157  NPV----VFLE---AKGYRE--I-QEHLIIK--LPKYSLFE--LENGRRRLLAS   -SELQKGNELFLPVDYMTFLYLA   1219
WP_037581760   1157  NPV----VFLE---AKGYRE--I-QEHLIIK--LPKYSLFE--LENGRRRLLAS   -SELQKGNELFLPVDYMTFLYLA   1219
WP_004232481   1189  NPV----SFLE---KKGYHN--V-QEDKLIK--LPKYSLFE--FEGGRRRLLAS   ATELQKGNEVVLPQYMVNLLYHS   1251
```

| ID | | | | | | |
|---|---|---|---|---|---|---|
| WP_009854540 | 1184 | NPV---EFLE---NKGYHN--I-REDKLIK--LPKYSLFE--FEGGRRRLLAS | ASELQKGNEMVLPGYLVELLYHA | 1246 |
| WP_012962174 | 1185 | NPV---VFLE---KKGYQN--V-QEDNLIK--LPKYSLFE--FEGGRRRLLAS | ASELQKGNEVVLsRHlVELLYHA | 1247 |
| WP_039695303 | 1186 | NPV---EFLE---NKGYHN--I-REDKLIK--LPKYSLFE--FEGGRRRLLAS | ASELQKGNEMVLPGYLVELLYHA | 1248 |
| WP_014334983 | 1189 | NPV---SFLE---KKGYHN--V-QEDKLIK--LPKYSLFE--FEGGRRRLLAS | ATELQKGNEVMLPAHLVELLYHA | 1251 |
| WP_003099269 | 1177 | DPI---AFLE---KKGYQD--I-QTSSIIK--LPKYSLFE--LENGKRKLLAS | --ELQKGNELALPNKVVKFLYLA | 1239 |
| AHY17476 | 1177 | DPI---AFLE---KKGYQD--I-QTSSIIK--LPKYSLFE--LENGKRKLLAS | --ELQKGNELALPNKVVKFLYLA | 1239 |
| ESR09100 | 9 | DPI---AFLE---KKGYQD--I-QTSSIIK--LPKYSLFE--LENGKRKLLAS | -KELQKGNELALPNKVVKFLYLA | 71 |
| AGM98575 | 1177 | DPI---AFLE---KKGYQD--I-QTSSIIK--LPKYSLFE--LENGKRKLLAS | --ELQKGNELALPNKVVKFLYLA | 1239 |
| ALF27331 | 1159 | EPEr---FLA---QKGFER--V-EKT-IK--LPKYSLFE--MEKGRRRLLAS | SGELQKGNQVLlPEHLIRLLSYA | 1221 |
| WP_018372492 | 1168 | NPI---AYLE---ECGYRN--V-NPNLIIK--LPKYSLFE--FNNGQRRLLAS | SIELQKGNEIVPYHFTALLLYHA | 1228 |
| WP_045618028 | 1189 | NPI---TFLE---NKGYHN--V-RKENILC--LPKYSLFE--LENGRRRLLAS | AKELQKGNEIVLPVYLTTLLYHS | 1251 |
| WP_045635197 | 1184 | DPV---AFLE---RKGYRN--V-QEENIIK--LPKYSLFK--LENGRRRLLAS | ARELQKGNEIVLPNHLGTLLYHA | 1246 |
| WP_002263549 | 1159 | DPV---AFLE---RKGYRN--V-QEENIIK--LPKYSLFK--LENGRKRLLAS | ARELQKGNEIVLPNHLGTLLYHA | 1221 |
| WP_002263887 | 1159 | DPV---AFLE---RKGYRN--V-QEENIIK--LPKYSLFK--LENGRKRLLAS | ARELQKGNEIVLPNHLGTLLYHA | 1221 |
| WP_002264920 | 1159 | DPV---AFLE---RKGYRN--V-QEENIIK--LPKYSLFK--LENGRKRLLAS | ARELQKGNEIVLPNHLGTLLYHA | 1221 |
| WP_002269043 | 1159 | DPV---AFLE---RKGYRN--V-QEENIIK--LPKYSLFK--LENGRKRLLAS | ARELQKGNEIVLPNHLGTLLYHA | 1221 |
| WP_002269448 | 1159 | DPV---AFLE---RKGYRN--V-QEENIIK--LPKYSLFK--LENGRKRLLAS | ARELQKGNEIVLPNHLGTLLYHA | 1221 |
| WP_002271977 | 1159 | DPV---AFLE---RKGYRN--V-QEENIIK--LPKYSLFK--LENGRKRLLAS | ARELQKGNEIVLPNHLGTMLLYHA | 1221 |
| WP_002272766 | 1159 | DPV---AFLE---RKGYRN--V-QEENIIK--LPKYSLFK--LENGRKRLLAS | ARELQKGNEIVLPNHLGTLLYHA | 1221 |
| WP_002273241 | 1159 | DPV---AFLE---RKGYRN--V-QEENIIK--LPKYSLFK--LENGRKRLLAS | ARELQKGNEIVLPNHLGTLLYHA | 1221 |
| WP_002275430 | 1159 | DPV---AFLE---RKGYRN--V-QEENIIK--LPKYSLFK--LENGRKRLLAS | ARELQKGNEIVLPNHLGTLLYHA | 1221 |
| WP_002276448 | 1159 | DPV---AFLE---RKGYRN--V-QEENIIK--LPKYSLFK--LENGRKRLLAS | ARELQKGNEIVLPNHLGTLLYHA | 1221 |
| WP_002277050 | 1167 | NPV---KFLK---DKGYQQ--I-EKNNFVK--LPKYTLVD--IGNGIKRLWAS | SKEVHKGNQLVVSKKSQDLLYHA | 1229 |
| WP_002773364 | 1159 | DPV---AFLE---RKGYRN--V-QEENIIK--LPKYSLFK--LENGRKRLLAS | ARELQKGNEIVLPNHLGTLLYHA | 1221 |
| WP_002279025 | 1159 | DPV---AFLE---RKGYRN--V-QEENIIK--LPKYSLFK--LENGRKRLLAS | ARELQKGNEIVLPNHLGTLLYHA | 1221 |
| WP_002279859 | 1159 | DPV---AFLE---RKGYRN--V-QEENIIK--LPKYSLFK--LENGRKRLLAS | ARELQKGNEIVLPNHLGTLLYHA | 1221 |
| WP_002280230 | 1159 | DPI---AFLE---RKGYRN--V-QEENIIK--LPKYSLFK--LENGRKRLLAS | ARELQKGNEIVLPNHLGTLLYHA | 1221 |
| WP_002281696 | 1159 | DPV---AFLE---RKGYRN--V-QEENIIK--LPKYSLFK--LENGRKRLLAS | ARELQKGNEIVLPNHLGTLLYHA | 1221 |
| WP_002282247 | 1167 | NPV---KFLK---DKGYQQ--I-EKNNFVK--LPKYTLVD--IGNGIKRLWAS | SKEVHKGNQLVVSKKSQDLLYHA | 1229 |
| WP_002282906 | 1159 | DPV---AFLE---RKGYRN--V-QEENIIK--LPKYSLFK--LENGRKRLLAS | ARELQKGNEIVLPNHLETLLYHA | 1221 |
| WP_002283846 | 1159 | DPV---AFLE---RKGYRN--V-QEENIIK--LPKYSLFK--LENGRKRLLAS | ARELQKGNEIVLPNHLGTLLYHA | 1221 |
| WP_002287255 | 1159 | DPI---AFLE---RKGYRN--V-QEENIIK--LPKYSLFK--LENGRKRLLAS | ARELQKGNEIVLPNHLGTLLYHA | 1221 |
| WP_002288990 | 1159 | DPV---AFLE---RKGYRN--V-QEENIIK--LPKYSLFK--LENGRKRLLAS | ARELQKGNEIVLPNHLGTLLYHA | 1221 |
| WP_002289641 | 1159 | DPV---AFLE---RKGYRN--V-QEENIIK--LPKYSLFK--LENGRKRLLAS | ARELQKGNEIVLPNHLGTLLYHA | 1221 |
| WP_002290427 | 1159 | DPV---AFLE---RKGYRN--V-QEENIIK--LPKYSLFK--LENGRKRLLAS | ARELQKGNEIVLPNHLGTLLYHA | 1221 |
| WP_002295753 | 1159 | DPI---AFLE---RKGYRN--V-QEENIIK--LPKYSLFK--LENGRKRLLAS | ARELQKGNEIVLPNHLGTLLYHA | 1221 |
| WP_002296423 | 1159 | DPV---AFLE---RKGYRN--V-QEENIIK--LPKYSLFK--LENGRKRLLAS | ARELQKGNEIVLPNHLGTLLYHA | 1221 |
| WP_003044487 | 1173 | DPV---AFLE---RKGYRN--V-QEENIIK--LPKYSLFK--LENGRKRLLAS | ARELQKGNEIVLPNHLETLLYHA | 1235 |
| WP_003055844 | 1159 | DPV---AFLE---RKGYRN--V-QEENIIK--LPKYSLFK--LENGRKRLLAS | ARELQKGNEIVLPNHLGTLLYHA | 1221 |
| WP_003057203 | 1159 | DPI---AFLE---RKGYRN--V-QEENIIK--LPKYSLFK--LENGRKRLLAS | ARELQKGNEIVLPNHLGTLLYHA | 1221 |
| WP_003107890 | 1159 | DPV---AFLE---RKGYRN--V-QEENIIK--LPKYSLFK--LENGRKRLLAS | ARELQKGNEIVLPNHLGTLLYHA | 1221 |
| WP_003152408 | 1159 | DPV---AFLE---RKGYRN--V-QEENIIK--LPKYSLFK--LENGRKRLLAS | ARELQKGNEIVLPNHLGTLLYHA | 1221 |
| WP_012997688 | 1159 | DPV---AFLE---RKGYRN--V-QEENIIK--LPKYSLFK--LENGRKRLLAS | ARELQKGNEIVLPDHLGTLLYHA | 1221 |
| WP_014677909 | 1159 | DPV---AFLE---RKGYRN--V-QEENIIK--LPKYSLFK--LENGRKRLLAS | ARELQKGNEIVLPNHLGTLLYHA | 1221 |
| WP_019312892 | 1159 | DPV---AFLE---RKGYRN--V-QEENIIK--LPKYSLFK--LENGRKRLLAS | ARELQKGNEIVLPNHLGTLLYHA | 1221 |
| WP_019313659 | 1159 | DPV---AFLE---RKGYRN--V-QEENIIK--LPKYSLFK--LENGRKRLLAS | ARELQKGNEIVLPNHLGTLLYHA | 1221 |
| WP_019314093 | 1159 | DPV---AFLE---RKGYRN--V-QEENIIK--LPKYSLFK--LENGRKRLLAS | ARELQKGNEIVLPNHLGTLLYHA | 1221 |
| WP_019315370 | 1159 | DPV---AFLE---RKGYRN--V-QEENIIK--LPKYSLFK--LENGRKRLLAS | ARELQKGNEIVLPNHLGTLLYHA | 1221 |
| WP_019803776 | 1159 | DPV---AFLE---RKGYRN--V-QEENIIK--LPKYSLFK--LENGRKRLLAS | ARELQKGNEIVLPNHLGTLLYHA | 1221 |
| WP_019805234 | 1159 | DPV---AFLE---RKGYRN--V-QEENIIK--LPKYSLFK--LENGRKRLLAS | ARELQKGNEIVLPNHLGTLLYHA | 1221 |
| WP_024783594 | 1167 | NPV---KFLK---DKGYQQ--I-EKNNFVK--LPKYTLVD--IGNGIKRLWAS | SKEVHKGNQLVVSKKSQDLLYHA | 1229 |
| WP_024784288 | 1159 | DPV---AFLE---RKGYRN--V-QEENIIK--LPKYSLFK--LENGRKRLLAS | ARELQKGNEIVLPNHLGTLLYHA | 1221 |
| WP_024784666 | 1159 | DPV---AFLE---RKGYRN--V-QEENIIK--LPKYSLFK--LENGRKRLLAS | ARELQKGNEIVLPNHLGTLLYHA | 1221 |

-continued

```
WP_024784894  1159  DPV---AFLE---RKGYRN--V-QEENIIK---LPKYSLFK---LENGRKRLLAS  ARELQKGNEIVLPNHLGTLLYHA  1221
WP_024786433  1167  NPV---KFLK---DKGYQQ--I-EKNNFVK---LPKYTLVD---IGNGIKRLWAS  SKEVHKGNQLVVSKKSQDLLYHA  1229
WP_049473442  1159  DPV---AFLE---RKGYRN--V-QEENIIK---LPKYSLFK---LENGRKRLLAS  ARELQKGNEIVLPNHLGTLLYHA  1221
WP_049474547  1152  DPV---AFLE---RKGYRN--V-QEENIIK---LPKYSLFK---LENGRKRLLAS  ARELQKGNEIVLPNHLGTLLYHA  1214
EMC03581      1187  DPV---AFLE---RKGYRN--V-QEENIIK---LPKYSLFK---LENGRKRLLAS  AKELQKGNEIVLPVHLTTLLYHA  1249
WP_000428612  1185  NPI---TFLE---NKGYHN--V-RKENILC---LPKYSLFE---LKNGRRRMLAS  AKELQKGNEIVLPVYLTTLLYHS  1247
WP_000428613  1180  NPV---TFLE---GKGYQN--V-VBENIIR---LPKYSLFE---LENGRKRMLAS  AKELQKGNEMVLPSYIALLYHA  1242
WP_049523028  1146  DRI---TFLE---KKGYQD--I-QESLIIK---LPKFSLFE---LENGRKRLLAS  --ELQKGNELSLPNKYIQFLYLA  1208
WP_003107102  1179  NPI---AFLE---SKGYHD--I-QEHLMIT---LPKYSLFE---LENGQRRLLAS  -ELQKGNEMVLPQHLVTFLYRV  1241
WP_054279288  1189  NPT---AYLE---EYGYKN--I-NPNLIIK---LPKYSLFK---FNDGQRRLLAS  SIELQKGNELIIPYHFTLLYHA  1251
WP_049531101  1189  NPI---AYLE---ECGYKN--I-NPNLIIK---LPKYSLFK---FNGGQRRLLAS  SIELQKGNELIILPYHFTLLYHT  1251
WP_049538452  1191  NPI---AYLE---ECGYKN--I-NPNLIIK---LPKYSLFE---FNGGQRRLLAS  SIELQKGNELIIPYHFTALLYHA  1253
WP_049549711  1183  EFR44625     NPI---AFLE---KKGYQD--I-QEKLLIK---LPKYSLFE---LENGRRRLLAS  -EFQKGNELALSGKYMKFLYLA  1245
EFR44625      1135  DNI---AFLE---KKGYQD--I-QEKLLIK---LPKYSLFE---LENGRRRLLAS  -EFQKGNELALSGKYMKFLYLA  1197
WP_007896501  1184  NPI---TFLE---NKGYHN--V-RKENILC---LPKYSLFE---LENGRRRLLAS  AKELQKGNEIVLPVCLTTLLYHS  1246
WP_002897477  1190  NPV---TYLE---ECGYKN--I-NSNLIIK---LPKYSLFE---LENGRRRLLAS  SIELQKGNELILPYHLTALLYHA  1252
WP_002906454  1185  NPI---AFLE---NKGYHN--V-CKENILC---LPKYSLFE---LPKYSLFE---LENGRRRLLAS  AKELQKCNEIVLPVYLTTLLYHS  1247
WP_009729476  1175  NSV---TFLE---BKGYRN--I-RENTIIK---LPKYSLFE---LPKYSLFE---LENGRRRLLAS  AIELQKGNEMFLPQQFVNLLYHA  1237
CQR24647      1189  NPI---TFLE---NKGYHN--V-RKENILC---LPKYSLFE---LESGRRRMLAS  AKELQKGNEIVLPVYLTTLLYHS  1251
WP_000066813  1185  NPI---TFLE---NKGYHN--V-RKENILC---LPKYSLFE---LENGRRRLLAS  AKELQKGNEIVLPVYLTTLLYHS  1247
WP_009754323  1178  NPI---EFLE---HKGYKN--I-LEKNIIK---LPKYSLFE---LENGRRRLLAS  AKELQKGNEMILPPHLVTLLYHS  1240
WP_044674937  1180  NPI---EFLE---HKGYKN--I-LEKNIIK---LPKYSLFE---LENGRRRLLAS  AKELQKGNEMILPPHLVTLLYHS  1242
WP_044676715  1180  NPI---EFLE---HKGYKN--I-LEKNIIK---LPKYSLFE---LENGRRRLLAS  AKELQKGNEMILPPHLVTLLYHS  1242
WP_044680361  1178  NPI---EFLE---HKGYKN--I-LEKNIIK---LPKYSLFE---LENGRRRLLAS  AKELQKGNEMILPPHLVTLLYHS  1240
WP_044681799  1186  DKR---AFLL---GKGYKD--I-K--KIIE---LPKYSLFE---LKDGSRRMLAS  RGEIHKGNELFVPQKFTTLLYHA  1253
WP_049533112  1118  SETslqAYIA-EQIKSE--VeiLN--griILKYQLIS----NNGNRLYIAG  -SERHNARQLIVSDEAAKVIWLI  1181
WP_029090905  1150  EKI---NYIE---eKEGLSD--VrIIK---Dn-IPVNQMIEm---DGGEYLLTS  --EYVNARQLVLNEKQCALIADI  1211
WP_050506696  1177  NPI---DFLE---AKGYKE--V-VKDLIIK---LPKYSLFE---LENGRKRLLAS  -GELQKGNELALPSKVNFLYLA  1239
AIT42264      1150  QTT---EYLG---KIGFNK--AsIIN--S--FKNYTLFE---LPKYSLFE---LENGSRRMIVG  KGELQKGNQMVLPQNLLEFVHL  1217
WP_034440723  1177  NPI---DFLE---AKGYKE--V-KKDLIIK---LPKYSLFE---LENGRKRMLAS  -GELQKGNELALPSKVNFLYLA  1239
AKQ21048      1151  HPT---AYLE---EAGYNN--P-TV--LHE---LPKYQLFE---LEDGSRRMIAS  AKEFQKGNQMVLPLELVELLYHA  1211
WP_002364836  1157  NPI---LFLE---EKGFLR--P-RV--LMK---LPKYTLYE---FPEGRRRLLAS  AKEAQKGNQMVLPEHLLTLLYHA  1217
WP_016631044  1108  NPI---LFLE---EKGFLR--P-RV--LMK---LPKYTLYE---FPEGRRRLLAS  AKEAQKGNQMVLPEHLLTLLYHA  1168
EMS75795      893   DPI---GFLS---NKGYSN--V-TKP--IK---LSKYTLYE---LENGRRRMVAS  -KEAQKANSFLLPEKLVTLLYHA  953
WP_002373311  1157  NPI---LFLE---EKGFLR--P-RV--LMK---LPKYTLYE---FPEGRRRLLAS  AKEAQKGNQMVLPEHLLTLLYHA  1217
WP_002378009  1157  NPI---LFLE---EKGFLR--P-RV--LMK---LPKYTLYQ---FPEGRRRLLAS  AKEAQKGNQMVLPEHLLTLLYHA  1217
WP_002407324  1157  NPI---LFLE---EKGFLR--P-RV--LMK---LPKYTLYE---FPEGRRRLLAS  AKEAQKGNQMVLPEHLLTLLYHA  1217
WP_002413717  1159  NPI---LFLE---EKGFLR--P-RV--LMK---LPKYTLYE---FPEGRRRLLAS  AKEFQKGNQMVLPEHLLTLLYHA  1219
WP_010775580  1157  NPI---LFLE---EKGFLR--P-RV--LMK---LPKYTLYE---FPEGRRRLLAS  AKEAQKGNQMVLPEHLLTLLYHA  1217
WP_010818269  1159  NPI---LFLE---EKGFLR--P-RV--LMK---LPKYTLYE---FPEGRRRLLAS  AKEAQKGNQMVLPEHLLTLLYHA  1219
WP_010824395  1157  NPI---LFLE---EKGFLR--P-RV--LMK---LPKYTLYE---FPEGRRRLLAS  AKEAQKGNQMVLPEHLLTLLYHA  1217
WP_016622645  1157  NPI---LFLE---EKGFLR--P-RV--LMK---LPKYTLYE---FPEGRRRLLAS  AKEAQKGNQMVLPEHLLTLLYHA  1217
WP_033624816  1157  NPI---LFLE---EKGFLR--P-RV--LMK---LPKYTLYE---FPEGRRRLLAS  AKEAQKGNQMVLPERLLTLLYHA  1217
WP_033625576  1157  NPI---LFLE---EKGFLR--P-RV--LMK---LPKYTLYE---FPEGRRRLLAS  AKEAQKGNQMVLPEHLLTLLYHA  1217
WP_033789179  1157  NPI---LFLE---EKGFLR--P-RV--LMK---LPKYTLYE---FPEGRRRLLAS  AKEAQKGNQMVLPEHLLTLLYHA  1217
WP_002310644  1159  SPV---LFLK---NKGYEQ--A-EIE--MK---LPKYALFE---LENGRKRMVAS  -KEAQKANSFLLPEHLVTLLYHA  1219
WP_002312694  1160  SPV---LFLK---NKGYEQ--A-EIE--MK---LPKYALFE---LENGRKRMVAS  -KEAQKANSFLLPEHLVTLLYHA  1220
WP_002314015  1160  SPV---LFLK---NKGYEQ--A-EIE--MK---LPKYALFE---LENGRKRMVAS  -KEAQKANSFLLPEHLVTLLYHA  1220
WP_002320716  1159  SPV---LFLK---NKGYEQ--A-EIE--MK---LPKYALFE---LENGRKRMVAS  -KEAQKANSFLLPEHLVTLLYHA  1219
WP_002330729  1160  SPV---LFLK---NKGYEQ--A-EIE--MK---LPKYALFE---LENGRKRMVAS  -KEAQKANSFLLPEHLVTLLYHA  1220
WP_002335161  1160  SPV---LFLK---NKGYEQ--A-EIE--MK---LPKYALFE---LENGRKRMVAS  -KEAQKANSFLLPEHLVTLLYHA  1220
WP_002345439  1160  SPV---LFLK---NKGYEQ--A-EIE--MK---LPKYALFE---LENGRKRMVAS  -KEAQKANSFLLPEHLVTLLYHA  1220
WP_034867970  1150  DPT---TFLK---EKGFPQ--V-TEF--IK---LPKYTLFE---FDNGRRRFLAS  -KESQKGNPFILSDQLVTLLYHA  1210
```

-continued

| ID | | | | | |
|---|---|---|---|---|---|
| WP_047937432 | 1160 | SPV---LFLK---NKGYEQ--A-EIE--MK--LPKYALFE---LENGRKRMVAS | -KEAQKANSFLLPEHLVTLLYHA | 1220 |
| WP_010720994 | 1150 | DPT----TFLK---DKGFPQ--V-TEF--IK--LPKYTLFE---FDNGRRRFLAS | -KESQKGNPFILSDQLVTLLYHA | 1210 |
| WP_010737004 | 1150 | DPT----TFLK---DKGFPQ--V-TEF--IK--LPKYTLFE---FDNGRRRFLAS | -KESQKGNPFILSDQLVTLLYHA | 1210 |
| WP_034700478 | 1150 | DPT----TFLK---DKGFPH--V-TEF--IK--LPKYTLFE---FDNGRRRFLAS | -KESQKGNPFILSDQLVTLLYHA | 1210 |
| WP_007209003 | 1148 | NPII---YLS----KKDYHN--pKVEAI-----LPKYSLFE---FENGRRRMVAS | -SETQKGNQLIIPGHLMELLYHS | 1208 |
| WP_023519017 | 1144 | DPR----EFLK---TKGYEG--V-KQW--LI--LPKYILFE---AQGGYRRMIAS | -QETQKANSLILPENLVTLLYHA | 1204 |
| WP_010770040 | 1155 | DPV----SLLE---NKGYAN--P-EV---LIH-LPKYTLYE---LENGRRRLLAS | ANEAQKGNQVLPASLVTLLYHA | 1215 |
| WP_048604708 | 1152 | NER----EFLK---NKGYQN--P-QI--CMK--LPKYSLYE---FDDGRRRLLAS | AKEAQKGNQMVLPAHLVTFLYHA | 1212 |
| WP_010750235 | 1153 | DPI----SFLI---EKGYSN--V-NQF--IK--LPKYTLFE---LANGQRRMLAS | -QELQKANSFILPEKLVTLLYHA | 1213 |
| AII16583 | 1216 | NPI----DFLE---AKGYKE--V-KKDLIIK--LPKYSLFE---LENGRKRMLAS | -GELQKGNELALPSKVNFLYLA | 1278 |
| WP_029073316 | 1165 | TKI----NYIK--eSRGLEE--VKIIK-----E--ILKNQLIEi-----NGGLFYVTS | -EIVNARQLILDFNCTRIIDGI | 1225 |
| WP_031589969 | 1165 | NYLK--gAEDLEE--VqIGK-----E--ILKNQLIEk-----DGGLYYIVA | -EIINAKQLILNESQTKLVCEI | 1225 |
| KDA45870 | 1139 | DPT----AYLA---SRGYTNvtNsFIL------PKYSLLEd-----PEGRRRYLAS | -KEFQKANELIIPQHLVELLYWV | 1199 |
| WP_039099354 | 1171 | QKI-spQFTKv---KKQKGtiV-KVVEDFEv-IAPHILINqrFDNGqEBLTLGS | -HNEQELILDKTAVKLLNGA | 1241 |
| AKP02966 | 1173 | KTL--qNWLE---ENVKHKsIqIIK---Nn-VPIGQIIY------SKKVGLLS | -REIANRQQLILPPEHSALLRIL | 1237 |
| WP_010991369 | 1155 | DEK----AFLE---EQGYRQ--P-KV---LAK--LPKYTLYE---CEEGRRRMLAS | ANEAQKGNQQVLPNHLVTLLHHA | 1215 |
| WP_033838504 | 1155 | DEK----AFLE---EQGYRQ--P-KV---LAK--LPKYTLYE---CEEGRRRMLAS | ANEAQKGNQQVLPNHLVTLLHHV | 1215 |
| EHN60060 | 1158 | DEK----AFLE---EQGYRQ--P-KV---LAK--LPKYTLYE---CEEGRRRMLAS | ANEAQKGNQQVLPNHLVTLLHHA | 1218 |
| EFR89594 | 924 | DEK----AFLE---EQGYRQ--P-KV---LAK--LPKYTLYE---CENGRRRMLAS | ANEAQKGNQMVLPNHLMTLLYHA | 984 |
| WP_038409211 | 1155 | DQK----AFLE---EKGYYS--P-KV---LTK--IPKYTLYE---CENGRRRMLGS | ANEAQKGNQMVLPNHLMTLLYHA | 1215 |
| EFR95520 | 774 | DQK----AFLE---EKGYYS--P-KV---LTK--IPKYTLYE---CENGRRRMLGS | ANEAQKGNQMVLPNHLMTLLYHA | 834 |
| WP_003723650 | 1155 | DEE----AFLE---EKGYRH--P-KV---LTK--LPKYTLYE---CEKGRRRMLAS | ANEAQKGNQLVLSNHLVSLLYHA | 1215 |
| WP_003727705 | 1155 | DEE----AFLE---EKGYHQ--P-KV---LTK--LPKYTLYE---CEKGRRRMLAS | ANEAQKGNQLVLSNHLVSLLYHA | 1215 |
| WP_003730785 | 1155 | DEE----AFLE---EKGYHQ--P-KV---LTK--LPKYTLYE---CEKGRRRMLAS | ANEAQKGNQLVLSNHLVSLLYHA | 1215 |
| WP_003733029 | 1155 | DEK----TFLE---BKGYHQ--P-KV---LIK--VPKYTLYE---CKNGRRRMLGS | ANEAQKGNQMLLPNHLMALLYHA | 1215 |
| WP_003739838 | 1155 | DEK----SFLE---KQGYRQ--P-KV---LTK--LPKYTLYE---CENGRRRMLAS | ANEAQKGNQQVLKGQLITLLHHA | 1215 |
| WP_014601172 | 1155 | DEK----AFLE---EKGYRH--P-KV---LTK--LPKYTLYE---CEKGRRRMLAS | ANEVHKGNQLLPNHLMTLLYHA | 1215 |
| WP_023548323 | 1155 | DEK----VFLE---EKGYHQ--P-KV---LTK--LPKYALYE---CENGRRRMLAS | ANEVHKGNQMLPNHLMTLLYHA | 1215 |
| WP_031665337 | 1155 | DEK----AFLE---EKGYRH--P-KV---LTK--LPKYTLYE---CENGRRRMLAS | ANEAHKGNQMLLPNHLVSLLYHA | 1215 |
| WP_031669209 | 1155 | DEK----TFLE---GKGYHQ--P-KV---LIK--VPKYALYE---CENGRRRMLGS | ANEAHKGNQMLLPNHLMALLYHA | 1215 |
| WP_033920898 | 1155 | DEE----AFLE---GKGYHQ--P-KV---ITK--LPKYTLYE---CENGRRRMLGS | ANEAQKGNQLVLSNHLVSLLYHA | 1215 |
| AKI42028 | 1158 | DEE----AFLE---EKGYRH--P-KV---LTK--LPKYTLYE---CENGRRRMLAS | ANEAQKGNQLVLSNHLVSLLYHA | 1218 |
| AKI50529 | 1158 | DEK----VFLE---GKGYHQ--P-KV---LTK--LPKYALYE---CENGRRRMLAS | ANEVHKGNQMLPNHLMTLLYHA | 1218 |
| EFR83390 | 603 | DEE----AFLE---EKGYRH--P-KV---LTK--LPKYTLYE---CEKGRRRMLAS | ANEAQKGNQMVLPNHLMTLLYHA | 663 |
| WP_046323366 | 1155 | DQK----EFLE---GKGYRN--P-KV---ITK--IPKYTLYE---LPKYTLYE---CENGRRRMLGS | ANEAQKGNELALPSKVNFLYLA | 1215 |
| AKE81011 | 1193 | NPI----DFLE---AKGYKE--V-KKDLIIK--LPKYSLFE---LENGRKRMLAS | -GELQKGNELALPSKVNFLYLA | 1255 |
| CUO82355 | 1154 | EQI----EYVE--kEEKLSD--VkIIK----Nn-IPLNQLIEi-----DGRQYLLTS | -ECVNAMQLVLNEEQCKLIADI | 1215 |
| WP_033162887 | 1155 | EQL----SYIAspeHEDLID--VrIVK-----E--ILKNQLIEi-----DGGLYYVTS | -EYVTARQLSLNEQSCKLISEI | 1217 |
| AGZ01981 | 1210 | NPI----DFLE---AKGYKE--V-KKDLIIK--LPKYSLFE---LENGRKRMLAS | -GELQKGNELALPSKVNFLYLA | 1272 |
| AKA60242 | 1177 | NPI----DFLE---AKGYKE--V-KKDLIIK--LPKYSLFE---LENGRKRMLAS | -GELQKGNELALPSKVNFLYLA | 1239 |
| AKS40380 | 1177 | NPI----DFLE---AKGYKE--V-KKDLIIK--LPKYSLFE---LENGRKRMLAS | -GELQKGNELALPSKVNFLYLA | 1239 |
| 4UN5_B | 1181 | NPI----DFLE---AKGYKE--V-KKDLIIK--LPKYSLFE---LENGRKRMLAS | -GELQKGNELALPSKVNFLYLA | 1243 |

| ID | | | | | |
|---|---|---|---|---|---|
| WP_010922251 | 1240 | SHYEKLKgSPEDnEQKQL-FVEQHKHYLDEIIEQISEFSKRVILAD--ANLDKVL-S | AYN-KH---RDKPIREq- | 1305 |
| WP_039695303 | 1249 | HRAD---NFNS-TEYLN--YVSEHKKEFEKVLSCVEDFANLYVDE--KNLSKIR-A | VAD-SM---DNFSIEE-- | 1308 |
| WP_045635197 | 1247 | KNVH----KLDE-PGHLE--YIQKHRNEFKDLLNLVSEFSQKVLAD--ANLEKIK-S | LYA-DN---EQADIEI-- | 1306 |
| 5AXW_A | 979 | GELYRVIgVNNDILNRIE--VNMIDITYREYLENMNDKRPPRIIKTiaSKTQSIK-K | LYEVKSK--KHPQIIKtg | 1056 |
| WP_009880683 | 924 | SHYEKLKgSPEDnEQKQL-FVEQHKHYLDEIIEQISEFSKRVILAD--ANLDKVL-S | AYN-KH---RDKPIREq- | 989 |
| WP_010922251 | 1240 | SHYEKLKgSPEDnEQKQL-FVEQHKHYLDEIIEQISEFSKRVILAD--ANLDKVL-S | AYN-KH---RDKPIREq- | 1305 |
| WP_011054416 | 1240 | SHYEKLKgSPEDnEQKQL-FVEQHKHYLDEIIEQISEFSKRVILAD--ANLDKVL-S | AYN-KH---RDKPIREq- | 1305 |
| WP_011284745 | 1240 | SHYEKLKgSPEDnEQKQL-FVEQHKHYLDEIIEQISEFSKRVILAD--ANLDKVL-S | AYN-KH---RDKPIREq- | 1305 |
| WP_011285506 | 1240 | SHYEKLKgSPEDnEQKQL-FVEQHKHYLDEIIEQISEFSKRVILAD--ANLDKVL-S | AYN-KH---RDKPIREq- | 1305 |
| WP_011527619 | 1240 | SHYEKLKgSPEDnEQKQL-FVEQHKHYLDEIIEQISEFSKRVILAD--ANLDKVL-S | AYN-KH---RDKPIREq- | 1305 |

```
                              -continued
WP_012560673  1240  SHYEKLKgSPEDnEQKQL--FVEQHKHYLDEIIEQISEFSKRVILAD--ANLDKVL-S  AYN-KH---RDKPIREq-  1305
WP_014407541  1239  SHYEKLKgSPEDnEQKQL--FVEQHKHYLDEIIEQISEFSKRVILAD--ANLDKVL-S  AYN-KH---RDKPIREq-  1304
WP_020905136  1240  SHYEKLKgSPEDnEQKQL--FVEQHKHYLDEIIEQISEFSKRVILAD--ANLDKVL-S  AYN-KH---RDKPIREq-  1305
WP_023080005  1239  SHYEKLKgSPEDnEQKQL--FVEQHKHYLDEIIEQISEFSKRVILAD--ANLDKVL-S  AYN-KH---RDKPIREq-  1304
WP_023610282  1239  SHYEKLKgSPEDnEQKQL--FVEQHKHYLDEIIEQISEFSKRVILAD--ANLDKVL-S  AYN-KH---RDKPIREq-  1304
WP_030125963  1240  SHYEKLKgSPEDnEQKQL--FVEQHKHYLDEIIEQISEFSKRVILAD--ANLDKVL-S  AYN-KH---RDKPIREq-  1305
WP_030126706  1240  SHYEKLKgSPEDnEQKQL--FVEQHKHYLDEIIEQISEFSKRVILAD--ANLDKVL-S  AYN-KH---RDKPIREq-  1305
WP_031488318  1240  SHYEKLKgSPEDnEQKQL--FVEQHKHYLDEIIEQISEFSKRVILAD--ANLDKVL-S  AYN-KH---RDKPIREq-  1305
WP_032460140  1240  SHYEKLKgSPEDnEQKQL--FVEQHKHYLDEIIEQISEFSKRVILAD--ANLDKVL-S  AYN-KH---RDKPIREq-  1305
WP_032461047  1240  SHYEKLKgSPEDnEQKQL--FVEQHKHYLDEIIEQISEFSKRVILAD--ANLDKVL-S  AYN-KH---RDKPIREq-  1305
WP_032462016  1240  SHYEKLKgSPEDnEQKQL--FVEQHKHYLDEIIEQISEFSKRVILAD--ANLDKVL-S  AYN-KH---RDKPIREq-  1305
WP_032462936  1240  SHYEKLKgSPEDnEQKQL--FVEQHKHYLDEIIEQISEFSKRVILAD--ANLDKVL-S  AYN-KH---RDKPIREq-  1305
WP_032464890  1240  SHYEKLKgSPEDnEQKQL--FVEQHKHYLDEIIEQISEFSKRVILAD--ANLDKVL-S  AYN-KH---RDKPIREq-  1305
WP_033888930  1065  SHYEKLKgSPEDnEQKQL--FVEQHKHYLDEIIEQISEFSKRVILAD--ANLDKVL-S  AYN-KH---RDKPIREq-  1130
WP_038431314  1240  SHYEKLKgSPEDnEQKQL--FVEQHKHYLDEIIEQISEFSKRVILAD--ANLDKVL-S  AYN-KH---RDKPIREq-  1305
WP_038432938  1239  SHYEKLKgSPEDnEQKQL--FVEQHKHYLDEIIEQISEFSKRVILAD--ANLDKVL-S  AYN-KH---RDKPIREq-  1304
WP_038434062  1240  SHYEKLKgSPEDnEQKQL--FVEQHKHYLDEIIEQISEFSKRVILAD--ANLDKVL-S  AYN-KH---RDKPIREq-  1305
BAQ51233      1151  SHYEKLKgSPEDnEQKQL--FVEQHKHYLDEIIEQISEFSKRVILAD--ANLDKVL-S  AYN-KH---RDKPIREq-  1216
KGE60162      415   SHYEKLKgSPEDnEQKQL--FVEQHKHYLDEIIEQISEFSKRVILAD--ANLDKVL-S  AYN-KH---RDKPIREq-  480
KGE60856      178   SHYEKLKgSPEDnEQKQL--FVEQHKHYLDEIIEQISEFSKRVILAD--ANLDKVL-S  AYN-KH---RDKPIREq-  243
WP_002989955  1240  SHYEKLKgSPEDnEQKQL--FVEQHKHYLDEIIEQISEFSKRVILAD--ANLDKVL-S  AYN-KH---RDKPIREq-  1305
WP_003030002  1222  YQIE---KNYE-PEHRE-YVEKHDEFKELLEYISVPSRKKVLAD--NNLTKIE-M      LFS-KN---KDAEVSS-   1281
WP_003065552  1250  QRIN----SENS-TKYLD-YVSAHKKEFPKVLSCVEDFANLYVDVE-KNLSKIR-A     VAD-SM---DNFSIEE-   1309
WP_001040076  1249  SRYNESKgKPEEiEKKQE--FVNQHVSYFDDILQIINDFSKRVILAD--ANLEKIR-R   LYQ-DNK--ENIPVDE-   1314
WP_001040080  1241  SRYNESKgKPEEiEKKQE--FVNQHVSYFDDILQIINDFSKRVILAD--ANLEKIN-K   LYQ-DNK--ENISVDE-   1306
WP_001040081  1241  SRYNESKgKPEEiEKKQE--FVNQHVSYFDDILQIINDFSKRVILAD--ANLEKIN-K   LYQ-DNK--ENISVDE-   1306
WP_001040083  1241  SRYNESKgKPEEiEKKQE--FVNQHVSYFDDILQIINDFSKRVILAD--ANLEKIN-K   LYQ-DNK--ENISVDE-   1306
WP_001040085  1241  SRYNESKgKPEEiEKKQE--FVNQHVSYFDDILQIINDFSKRVILAD--ANLEKIN-K   LYQ-DNK--ENISVDE-   1306
WP_001040087  1241  SRYNESKgKPEEiEKKQE--FVNQHVSYFDDILQIINDFSKRVILAD--ANLEKIN-K   LYQ-DNK--ENISVDE-   1306
WP_001040088  1241  SRYNESKgKPEEiEKKQE--FVNQHVSYFDDILQIINDFSKRVILAD--ANLEKIN-K   LYQ-DNK--ENISVDE-   1306
WP_001040089  1241  SRYNESKgKPEEiEKKQE--FVNQHVSYFDDILQIINDFSKRVILAD--ANLEKIN-K   LYQ-DNK--ENISVDE-   1306
WP_001040090  1241  SRYNELKgKPEEiEQKQE--FVVQHVSYFDDILQIINDFSNRVILAD--ANLEKIN-K   LYQ-DNK--ENIPVDE-   1306
WP_001040091  1241  SRYNELKgKPEEiEQKQE--FVVQHVSYFDDILQIINDFSNRVILAD--ANLEKIN-K   LYQ-DNK--ENIPVDE-   1306
WP_001040092  1241  SRYNELKgKPEEiEKKQE--FVVQHISYFDDILQIINDFSNRVILAD--ANLEKIN-K   LYS-DNK--ENIPVDE-   1306
WP_001040094  1241  SRYNELKgKPEEiEKKQE--FVVQHVSYFDDILQIINDFSNRVILAD--ANLEKIN-K   LYQ-DNK--ENIPVDE-   1306
WP_001040095  1241  SRYNELKgKPEEiEKKQE--FVVQHVSYFDDILQIINDFSNRVILAD--ANLEKIN-K   LYQ-DNK--ENIPVDE-   1306
WP_001040096  1241  SRYNELKgKPEEiEKKQE--FVVQHVSYFDDILQIINDFSNRVILAD--ANLEKIN-K   LYQ-DNK--ENIPVDE-   1306
WP_001040097  1241  SRYNELKgKPEEiEQKQE--FVVQHVSYFDDILQIINDFSNRVILAD--ANLEKIN-K   LYQ-DNK--ENIPVDE-   1306
WP_001040098  1241  SRYNELKgKPEEiEQKQE--FVVQHVSYFDDILQIINDFSNRVILAD--ANLEKIN-K   LYQ-DNK--ENIPVDE-   1306
WP_001040099  1241  SRYNELKgKPEEiEKKQE--FVVQHVSYFDDILQIINDFSNRVILAD--ANLEKIN-K   LYQ-DNK--ENIPVDE-   1306
WP_001040100  1241  SRYNELKgKPEEiEKKQE--FVVQHVSYFDDILQIINDFSNRVILAD--ANLEKIN-K   LYQ-DNK--ENIPVDE-   1306
WP_001040104  1241  SRYNELKgKPEEiEKKQE--FVVQHVSYFDDILQIINDFSNRVILAD--ANLEKIN-K   LYQ-DNK--DNTPVDE-   1306
WP_001040105  1241  SRYNELKgKPEEiEKKQE--FVVQHVSYFDDILQIINDFSNRVILAD--ANLEKIN-K   LYQ-DNK--ENIPVDE-   1306
WP_001040106  1241  SRYNELKgKPEEiEQKQE--FVVQHVSYFDDILQIINDFSNRVILAD--ANLEKIN-K   LYQ-DNK--ENIPVDE-   1306
WP_001040107  1241  SRYNELKgKPEEiEQKQE--FVVQHVSYFDDILQIINDFSNRVILAD--ANLEKIN-K   LYQ-DNK--ENIPVDE-   1306
WP_001040108  1241  SRYNELKgKPEEiEQKQE--FVVQHVSYFDDILQIINDFSNRVILAD--ANLEKIN-K   LYQ-DNK--ENIPVDE-   1306
WP_001040109  1241  SRYNELKgKPEEiEQKQE--FVVQHVSYFDDILQIINDFSNRVILAD--ANLEKIN-K   LYQ-DNK--ENIPVDE-   1306
WP_001040110  1241  SRYNELKgKPEEiEQKQE--FVVQHVSYFDDILQIINDFSNRVILAD--ANLEKIN-K   LYQ-DNK--ENIPVDE-   1306
WP_015058523  1241  SRYNELKgKPEEiEKKQE--FVVQHVSYFDDILQIINDFSNRVILAD--ANLEKIN-K   LYS-DNK--ENIPVDE-   1306
WP_017643650  1241  SRYNELKgKPEEiEQKQE--FVVQHVSYFDDILQIINDFSNRVILAD--ANLEKIN-K   LYQ-DNK--DNTPVDE-   1306
WP_017647151  1241  SRYNELKgKPEEiEQKQE--FVVQHVSYFDDILQIINDFSNRVILAD--ANLEKIN-K   LYQ-DNK--ENIPVDE-   1306
WP_017648376  1241  SRYNELKgKPEEiEKKQE--FVVQHVSYFDDILQIINDFSNRVILAD--ANLEKIN-K   LYQ-DNK--ENISVDE-   1306
WP_017649527  1241  SRYNESKgKPEEiEKKQE--FVVQHVSYFDDILQIINDFSNRVILAD--ANLEKIN-K   LYQ-DNK--ENISVDE-   1306
```

```
WP_017771611   1241  SRYNELKgKPEEiEQKQE--FVVQHVSYFPDDILQIINDFSNRVILAD--ANLEKIN-K   LYQ-DNK--ENISVDE-   1306
WP_017771984   1241  SRYNESKgKPEEiEKKQE--FVNQHVSYFPDDILQIINDFSKRVILAD--ANLEKIN-K   LYQ-DNK--ENISVDE-   1306
CFQ25032       1241  SRYNESKgKPEEiEKKQE--FVVQHVSYFPDDILQIINDFSKRVILAD--ANLEKIN-K   LYQ-DNK--ENISVDE-   1306
CFV16040       1241  SRYNESKgKPEEiEKKQE--FVNQHVSYFPDDILQIINDFSKRVILAD--ANLEKIN-K   LYQ-DNK--ENISVDE-   1306
KLJ37842       1241  SRYNESKgKPEEiEKKQE--FVNQHVSYFPDDILQIINDFSKRVILAD--ANLEKIN-K   LYQ-DNK--ENISVDE-   1306
KLJ72361       1255  SRYNESKgKPEEiEKKQE--FVNQHVSYFPDDILQIINDFSKRVILAD--ANLEKIN-K   LYQ-DNK--ENISVDE-   1320
KLL20707       1241  SRYNESKgKPEEiEKKQE--FVNQHVSYFPDDILQIINDFSKRVILAD--ANLEKIN-K   LYQ-DNK--ENISVDE-   1306
KLL42645       1241  SRYNELKgKPEEiEQKQE--FVVQHVSYFPDDILQIINDFSNRVILAD--ANLEKIN-K   LYQ-DNK--ENIPVDE-   1306
WP_047207273   1241  SRYNESKgKPEEiEKKQE--FVNQHVSYFPDDILQIINDFSKRVILAD--ANLEKIN-K   LYQ-DNK--ENISVDE-   1306
WP_047209694   1241  SRYNESKgKPEEiEKKQE--FVNQHVSYFPDDILQIINDFSKRVILAD--ANLEKIN-K   LYS-DNK--DNTPVDE-   1306
WP_050198062   1241  SRYNESKgKPEEiEKKQE--FVNQHVSYFPDDILQIINDFSKRVILAD--ANLEKIN-K   LYQ-DNK--ENISVDE-   1306
WP_050201642   1241  SRYNESKgKPEEiEKKQE--FVNQHVSYFPDDILQIINDFSKRVILAD--ANLEKIN-K   LYQ-DNK--ENISVDE-   1306
WP_050204027   1241  SRYNESKgKPEEiEQKQE--FVVQHVSYFPDDILQIINDFSNRVILAD--ANLEKIN-K   LYQ-DNK--ENISVDE-   1306
WP_050881965   1241  SRYNESKgKPEEiEKKQE--FVNQHVSYFPDDILQIINDFSKRVILAD--ANLEKIN-K   LYQ-DNK--ENISVDE-   1306
WP_050886065   1241  SRYNESKgKPEEiEKKQE--FVNQHVSYFPDDILQIINDFSKRVILAD--ANLEKIN-K   LYQ-DNK--ENISVDE-   1306
AHN30376       1241  SRYNESKgKPEEiEKKQE--FVNQHVSYFPDDILQIINDFSKRVILAD--ANLEKIN-K   LYS-DNK--DNTPVDE-   1306
EAO78426       1241  SRYNESKgKPEEiEKKQE--FVNQHVSYFPDDILQIINDFSKRVILAD--ANLEKIN-K   LYQ-DNK--ENISVDE-   1306
CCW42055       1241  SRYNESKgKPEEiEKKQE--FVNQHVSYFPDDILQIINDFSNRVILAD--ANLEKIN-K   LYQ-DNK--ENISVDE-   1306
WP_003041502   1254  KRIN----NPIN-KDHIE--YVKKHRDFKELLNVLEFNEKYVGAT--KNGERLK-E     AVA-DF---DSKSNEE-   1313
WP_037593752   1223  YQIE----KNYE-PEHRE--YVEKHDEFKELLEYISVFSRKYVLAD--NNLTKIE-M    LFS-KN---KDAEVSS-   1282
WP_049516684   1223  YRIE----KDYE-PEHRE--YVEKHDEFKELLEYISVFSRKYVLAD--NNLTKIE-M    LFS-KN---KDAEVSS-   1282
GAD46167       1222  YQIE----KNYE-PEHRE--YVEKHDEFKELLEYISVFSRKYVLAD--NNLTKIE-M    LFS-KN---KDAEVSS-   1281
WP_018363470   1254  HRIG----NFNS-ABHLK--YVSEHKKEFEVLSCVENFANVYVDVE--KNLSKIR-A    AAD-SM---DNFSIEE-   1313
WP_003043819   1249  QNISATTgSNNLg-------YIEQHREEPKEIFEKIIDFSEKYLKIN--KVNSNLK-S   SFD-EQfavSDSIL--l   1310
WP_006269658   1222  YRIE----KDYE-PEHRE--YVEKHDEFKELLEYISVFSRKYVLAD--NNLTKIE-M    LFS-KN---KDAEVSS-   1281
WP_048800889   1242  HRID----NSDN-SEHLK--YITEHKEEFGKLLSYIENFAKSYVDVD--KNLSKIQ-L   AVE-KI---DSFSVKE-   1301
WP_012767106   1246  --HAHKIESSKE--LEHEA--YILDHYNDLYQLLSYIERFASLYVDVE--KNISKVK-E  LFS-NI---ESYSISEi   1308
WP_014612333   1246  --HAHKIESSKE--LEHEA--YILDHYNDLYQLLSYIERFASLYVDVE--KNISKVK-E  LFS-NI---ESYSISEi   1308
WP_015017095   1246  --HAHKIESSKE--LEHEA--YILDHYNDLYQLLSYIERFASLYVDVE--KNISKVK-E  LFS-NI---ESYSISEi   1308
WP_015057649   1246  --HAHKIESSKE--LEHEA--YILDHYNDLYQLLSYIERFASLYVDVE--KNISKVK-E  LFS-NI---ESYSISEi   1308
WP_048272215   1246  --HAHKIESSKE--LEHEA--YILDHYNDLYQLLSYIERFASLYVDVE--KNISKVK-E  LFS-NI---ESYSISEi   1308
WP_049519324   1246  --HAHKIESSKE--LEHEA--YILDHYNDLYQLLSYIERFASLYVDVE--KNISKVK-E  LFS-NI---ESYSISEi   1308
WP_012515931   1220  AHYHELTgSSEDvLRKKY--FVDRHLHYFDDIIQMINDFAERHILAS--SNLEKIN-H   TYH-NN---SDLPVNEr   1285
WP_021320964   1220  AHYHELTgSSEDvLRKKY--FVERHLHYFDDIIQMINDFAERHILAS--SNLEKIN-H   TYH-NN---SDLPVNEr   1285
WP_037581760   1220  AHYHELTgSSEDvLRKKY--FVESHLYYFPDVRLSQVFRVTNVEF---              -IN-EF---TEYGQED-   1308
WP_004232481   1252  QHVN----NSHK-PEHLN--YVKQHKDEFKDIFNLLIISARINILKP--KVVDNL---   VAD-SM---DNFSIEE-   1308
WP_009854540   1247  HRAD----NFNS-TEYLN--YVSEHKKEFKVLSCVEDFANLYVDVE--KNLSKIR-A    VAD-KI---DTFSIED-   1306
WP_012962174   1248  HRVN----SENN-SEHLK--YVSEHKKEGEVLSCVENFAKSYVDVE--KNLGKIR-A    VAD-SM---DNFSIEE-   1307
WP_039695303   1249  HRAD----NFNS-TEYLN--YVSEHKKEFKVLSCVEDFANLYVDVE--KNLSKIR-A    AAE-SM---TNFSLEE-   1308
WP_014334983   1252  HRID----SENS-TEHLK--YVSEHKKEFKVLSCVENFSNLYVDVE--KNLSKVR-A    LYK-EKG--NFSIEEq-   1311
WP_003099269   1240  SHYTKFTgKEEDrEKKRS--YVESHLYYFDEIMQIVEYSNRYILAD--SNLIKIQ-N   ---------------   1305
AHY15608       1240  SHYTKFTgKEEDrEKKRS--YVESHLYFXEVKSSF---                       ---------------   1273
AHY17476       1240  SHYTKFTgKEEDrEKKRS--YVESHLYPX-                               ---------------   1267
ESR09100       72    SHYTKFTgKEEDrEKKRS--YVESHLYYFDEIMQIVEYSNRYILAD--SNLIKIQ-N    LYK--Ek--DNFSIEEq-  137
AGM98575       1240  SHYTKFTgKEEDrEKKRS--YVESHLYYFPDVRLSQVFRVTNVEF-               ---------------   1281
ALF27331       1222  KNIH----KVDE-PKHLD--YVKKHDEFKELLDVVSNFSKKNILAE--SNLEKIE-E    LYA-QN---NNKDITE-   1281
WP_018372492   1229  KKVDVLVkSKDD--DYD---LEEHRAEFAELLDCIKKFNDMYILAS--SNMSKIE-E    IYQ-KN1--DAPIEE-   1289
WP_045618028   1257  QRIN----KISE-PIHKQ--YVETHQSEFKELLTAIISLSKKYI-QK--PNVESL---   LQQ-AF---DQSDKDIyq  1310
WP_045635197   1247  KNVH----KLDE-PGHLE--YIQKHRNEFKDLNLVSEFSQKYVLAD--ANLEKIK-S    LYA-DN---EQADIEI-   1306
WP_002263549   1222  KNIH----KVDE-PKHLD--YVDKHKDEFKELLDVVSNFSKKYTLAE--GNLEKIK-E   LYA-QN---NGEDLKE-   1281
WP_002263887   1222  KNIH----KVDE-PKHLD--YVDKHKDEFKELLDVVSNFSKKYTLAE--GNLEKIK-E   LYA-QN---NGEDLKE-   1281
WP_002264920   1222  KNIH----KVDE-PKHLD--YVDKHKDEFKELLDVVSNFSKKYTLAE--GNLEKIK-E   LYA-QN---NGEDLKE-   1281
WP_002269043   1222  KNIH----KVDE-PKHLD--YVDKHKDEFKELLDVVSNFSKKYTLAE--GNLEKIK-E   LYA-QN---NGEDLKE-   1281
WP_002269448   1222  KNIH----KVDE-PKHLD--YVDKHKDEFKELLDVVSNFSKKYTLAE--GNLEKIK-E   LYA-QN---NGEDLKE-   1281
```

-continued

| | | | | |
|---|---|---|---|---|
| WP_002271977 | 1222 | KNIH----KVDE-PKHLD--YVDKHKDEFKELLDVVSNFSKKYTLAE--GNLEKIK-E | LYA-QN----NGEDLKE-- | 1281 |
| WP_002272766 | 1222 | KNIH----KVDE-PKHLD--YVDKHKDEFKELLDVVSNFSKKYTLAE--GNLEKIK-E | LYA-QN----NGEDLKE-- | 1281 |
| WP_002273241 | 1222 | KNIH----KVDE-PKHLD--YVDKHKDEFKELLDVVSNFSKKYTLAE--GNLEKIK-E | LYA-QN----NGEDLKE-- | 1281 |
| WP_002275430 | 1222 | KNIH----KVDE-PKHLD--YVDKHKDEFKELLDVVSNFSKKYTLAE--GNLEKIK-E | LYA-QN----NGEDLKE-- | 1281 |
| WP_002276448 | 1222 | KNIH----KVDE-PKHLD--YVDKHKDEFKELLDVVSNFSKKYTLAE--GNLEKIK-E | LYA-QN----NGEDLKE-- | 1281 |
| WP_002277050 | 1230 | HHL------DN-DYSNE--YVKNHYQQFDILFNEITSFSKKCKLGK--EHIQKIE-E | AYSkER---DSASIEE-- | 1287 |
| WP_002277364 | 1222 | KNIH----KVDE-PKHLD--YVDKHKDEFKELLDVVSNFSKKYTLAE--GNLEKIK-E | LYA-QN----NGEDLKE-- | 1281 |
| WP_002279025 | 1222 | KNIH----KVDE-PKHLD--YVDKHKDEFKELLDVVSNFSKKYTLAE--GNLEKIK-E | LYA-QN----NGEDLKE-- | 1281 |
| WP_002279859 | 1222 | KNIH----KVDE-PKHLD--YVDKHKDEFKELLDVVSNFSKKYTLAE--GNLEKIK-E | LYA-QN----NGEDLKE-- | 1281 |
| WP_002280230 | 1222 | KNIH----KVDE-PKHLD--YVDKHKDEFKELLDVVSNFSKKYTLAE--GNLEKIK-E | LYA-QN----NGEDLKE-- | 1281 |
| WP_002281696 | 1222 | KNIH----KVDE-PKHLD--YVDKHKDEFKELLDVVSNFSKKYTLAE--GNLEKIK-E | AYSkER---DFASIEE-- | 1281 |
| WP_002282247 | 1230 | HHL------DN-DYSNE--YVKNHYQQFDILFNEITSFSKKCKLGK--EHIQKIE-E | AYSkER---DFASIEE-- | 1287 |
| WP_002282906 | 1222 | KNIH----KVDE-PKHLD--YVDKHKDEFKELLDVVSNFSKKYTLAE--GNLEKIK-E | LYA-QN----NGEDLKE-- | 1281 |
| WP_002283846 | 1222 | KNIH----KVDE-PKHLD--YVDKHKDEFKELLDVVSNFSKKYTLAE--GNLEKIK-E | LYA-QN----NGEDLKE-- | 1281 |
| WP_002287255 | 1222 | KNIH----KVDE-PKHLD--YVDKHKDEFKELLDVVSNFSKKYTLAE--GNLEKIK-E | LYA-QN----NGEDLKE-- | 1281 |
| WP_002288990 | 1222 | KNIH----KVDE-PKHLD--YVDKHKDEFKELLDVVSNFSKKYTLAE--GNLEKIK-E | LYA-QN----NGEDLKE-- | 1281 |
| WP_002289641 | 1222 | KNIH----KVDE-PKHLD--YVDKHKDEFKELLDVVSNFSKKYTLAE--GNLEKIK-E | LYA-QN----NGEDLKE-- | 1281 |
| WP_002290427 | 1222 | KNIH----KVDE-PKHLD--YVDKHKDEFKELLDVVSNFSKKYTLAE--GNLEKIK-E | LYA-QN----NGEDLKE-- | 1281 |
| WP_002295753 | 1222 | KNIH----KVDE-PKHLD--YVDKHKDEFKELLDVVSNFSKKYTLAE--GNLEKIK-E | LYA-QN----NGEDLKE-- | 1281 |
| WP_002296423 | 1222 | KNIH----KVDE-PKHLD--YVDKHKDEFKELLDVVSNFSKKYTLAE--GNLEKIK-E | LYA-QN----NGEDLKE-- | 1281 |
| WP_00304487 | 1236 | KNIH----KVDE-PKHLD--YVDKHKDEFKELLDVVSNFSKKYTLAE--GNLEKIK-E | LYA-QN----NGEDLKE-- | 1295 |
| WP_002305844 | 1222 | KNIH----KVDE-PKHLD--YVDKHKDEFKELLDVVSNFSKKYTLAE--GNLEKIK-E | LYA-QN----NGEDLKE-- | 1281 |
| WP_002307203 | 1222 | KNIH----KVDE-PKHLD--YVDKHKDEFKELLDVVSNFSKKYTLAE--GNLEKIK-E | LYA-QN----NGEDLKE-- | 1281 |
| WP_002310390 | 1222 | KNIH----KVDE-PKHLD--YVDKHKDEFKELLDVVSNFSKKYTLAE--GNLEKIK-E | LYA-QN----NGEDLKE-- | 1281 |
| WP_002352408 | 1222 | KNIH----KVDE-PKHLD--YVDKHKDEFKELLDVVSNFSKKYTLAE--GNLEKIK-E | LYA-QN----NGEDLKE-- | 1281 |
| WP_012997688 | 1222 | KNIH----KVDE-PKHLD--YVDKHKDEFKELLDVVSNFSKKYTLAE--GNLEKIK-E | LYA-QN----NGEDLKE-- | 1281 |
| WP_014677909 | 1222 | KNIH----KVDE-PKHLD--YVDKHKDEFKELLDVVSNFSKKYTLAE--GNLEKIK-E | LYA-QN----NGEDLKE-- | 1281 |
| WP_019312892 | 1222 | KNIH----KVDE-PKHLD--YVDKHKDEFKELLDVVSNFSKKYTLAE--GNLEKIK-E | LYA-QN----NGEDLKE-- | 1281 |
| WP_019313659 | 1222 | KNIH----KVDE-PKHLD--YVDKHKDEFKELLDVVSNFSKKYTLAE--GNLEKIK-E | LYA-QN----NGEDLKE-- | 1281 |
| WP_019314093 | 1222 | KNIH----KVDE-PKHLD--YVDKHKDEFKELLDVVSNFSKKYTLAE--GNLEKIK-E | LYA-QN----NGEDLKE-- | 1281 |
| WP_019315370 | 1222 | KNIH----KVDE-PKHLD--YVDKHKDEFKELLDVVSNFSKKYTLAE--GNLEKIK-E | LYA-QN----NGEDLKE-- | 1281 |
| WP_019803776 | 1222 | KNIH----KVDE-PKHLD--YVDKHKDEFKELLDVVSNFSKKYTLAE--GNLEKIK-E | LYA-QN----NGEDLKE-- | 1281 |
| WP_019805234 | 1222 | KNIH----KVDE-PKHLD--YVDKHKDEFKELLDVVSNFSKKYTLAE--GNLEKIK-E | LYA-QN----NGEDLKE-- | 1281 |
| WP_024783594 | 1222 | KNIH----KVDE-PKHLD--YVDKHKDEFKELLDVVSNFSKKYTLAE--GNLEKIK-E | LYA-QN----NGEDLKE-- | 1281 |
| WP_024784288 | 1230 | HHL------DN-DYSNE--YVKNHYQQFDILFNEITSFSKKCKLGK--EHIQKIE-E | AYSkER---DFASIEE-- | 1287 |
| WP_024784666 | 1222 | KNIH----KVDE-PKHLD--YVDKHKDEFKELLDVVSNFSKKYTLAE--GNLEKIK-E | LYA-QN----NGEDLKE-- | 1281 |
| WP_024784894 | 1222 | KNIH----KVDE-PKHLD--YVDKHKDEFKELLDVVSNFSKKYTLAE--GNLEKIK-E | LYA-QN----NGEDLKE-- | 1281 |
| WP_024786433 | 1230 | HHL------DN-DYSNE--YVKNHYQQFDILFNEITSFSKKCKLGK--EHIQKIE-E | AYSkER---DSASIEE-- | 1287 |
| WP_049473442 | 1222 | KNIH----KVDE-PKHLD--YVDKHKDEFKELLDVVSNFSKKYTLAE--GNLEKIK-E | LYA-QN----NGEDLKE-- | 1281 |
| WP_049474547 | 1215 | KNIH----KVDE-PKHLD--YVDKHKDEFKELLDVVSNFSKKYTLAE--GNLEKIK-E | LYA-QN----NGEDLKE-- | 1274 |
| EMC03581 | 1250 | KNVH----RLDE-PEHLE--YIQKHRNEFKGLNLVSEFSQKYVLAD--ANLEKIK-N | LYA-DN----EQADIEI-- | 1309 |
| WP_000428612 | 1248 | KNVH----KLDE-PEHLE--YIQKHRNEFKDLNLVSEFSQKYVLAD--ANLEKIQ-N | LYA-DN----EQADIEI-- | 1307 |
| WP_000428613 | 1243 | KRIQ----KKDE-PEHLE--YIKQHHSEFNDLLNFVSEFSQKYVLAE--SNLEKIK-T | LYI-DN----EQTNMEE-- | 1302 |
| WP_049523028 | 1209 | SRYTSFSgKEEDrEKHRH--FVESHLHYFDEIKDIIADFSRRYILAD--ANLEKIL-T | LYN-EKn---QFSIEEq-- | 1274 |
| WP_003107102 | 1242 | SKRDK----gTQSEhME---YISNHKEKFIEIFHYIIRYAEKNVIKP--KVIERLN-D | TFNqKF---NDSDLTEl-- | 1303 |
| WP_054279288 | 1252 | QRIN----KISE-PIHKQ--YVETHQSEFEELLTTIISLSKKYI-QK--PIVESL--- | LQQ-AF----EQADKDIyq | 1310 |
| WP_049531101 | 1252 | QRIN----KISE-PIHKQ--YVETHQSEFEELLTTIISLSKKYI-QK--PIVESL--- | LQQ-AF----EQADKDIyq | 1310 |
| WP_049538452 | 1254 | KPSE-PIHKQ--YVEAHQNEFKELLTIISLSKKYI-QK--PNVESL--- | LHQ-AF----EQADNDIyq | 1312 |
| WP_049549711 | 1246 | SRYDKLSsKIESeQQKKL--FVEQHLHYFDEILDIVVKHATCYIKAE--NNLKKII-S | LYK-KK----EAYSINEq-- | 1311 |
| WP_007896501 | 1198 | SRYDKLSsKIESeQQKKL--FVEQHLHYFDEILDIVVKHATCYIKAE--NNLKKII-S | LYK-KK----EAYSINEq-- | 1263 |
| EFR44625 | 1247 | QNLH----KLDE-PIHLE--YIQKHRNEFKDLNLVSEFSQKYILAE--ANLEKIK-D | LYA-DN----EQADIEI-- | 1306 |
| WP_002897477 | 1253 | QRIN----KISE-PIHKQ--YVEAHQNEFKELLTTIIISLSKKYI-QK--PNVELL--- | LQQ-AF----DQADKDIyq | 1311 |
| WP_002906454 | 1248 | KNVH----KLDE-PGHLE--YIQKHRNEFKDLNLVSEFSQKYVLAD--ANLEKIK-N | LYA-DN----EQADIEI-- | 1307 |
| WP_009729476 | | | | |

-continued

| | | | | |
|---|---|---|---|---|
| CQR24647 | 1238 | QHAN----KEDS----VI-YLEKHRHELSELFHHIIGVSEKTLKP--KVEMTLN-E | APE-KHf---EPDEVSE-- | 1295 |
| WP_000066813 | 1252 | KNVH------KLDE-PEHLE-YIQKHRYEFKDLLNIVSEFSQKYVLAD--ANLEKIK-N | LYA-DN---EQADIEI-- | 1311 |
| WP_009754323 | 1248 | KNVH------KLDE-PEHLE-YIQKHRYEFKDLLNIVSEFSQKYVLAE--ANLEKIK-S | LYV-DN---EQADIEI-- | 1307 |
| WP_044674937 | 1241 | SNIH------KITE-PIHLN-YVNKNKHEFKELLRHISDFSTRYILAQ--DRLSKIE-E | LYD-KN---DGDDISD-- | 1300 |
| WP_044676715 | 1243 | SNIH------KITE-PIHLN-YVNKNKHEFKELLRHISDFSTRYILAQ--DRLSKIE-E | LYD-KN---DGDDISD-- | 1302 |
| WP_044680361 | 1241 | SNIH------KITE-PIHLN-YVNKNKHEFKELLRHISDFSTRYILAQ--DRLSKIE-E | LYD-KN---DGDDISD-- | 1300 |
| WP_044681799 | 1241 | SNIH------KITE-PIHLN-YVNKNKHEFKELLRHISDFSTRYILAQ--DRLSKIE-E | LYD-KN---DGDDISD-- | 1300 |
| WP_049533112 | 1254 | KRIN------NPIN-KDHIE-YVKKHRDDFKELLNYVLEFNEKYVGAT--KNGERLK-E | AVA-DF---DSKSNEE-- | 1313 |
| WP_029090905 | 1182 | STKQA-----DE-AMFLKyyRLEHLEAVFEEL---IRKQAADYQIFE--KLIKKIEvN | FYS----c----TYNEk-- | 1240 |
| WP_006506696 | 1212 | YNAIYKQ-DYDNlDDILMi-------QLYIELTNRKMKVLYPAY-rGIAEKFE-S | YVV-----i---SKEEk-- | 1268 |
| AIT42264 | 1240 | SHYEKLKgSPEDnRQKQL-FVEQHKHYLDEIIEQISEFSKRVILAD--ANLDKVL-S | AYN-KH---RDKPIREq-- | 1305 |
| WP_024440723 | 1218 | KHYNE-----DE-TSHK-FIVEHKAYFDELLNIVIEFANKYLELE--NSIEKIK-D | LYH-----gKGPDVEEke | 1276 |
| AKQ21048 | 1240 | SHYEKLKgSPEDnEQKQL-FVEQHKHYLDEIIEQISEFSKRVILAD--ANLDKVL-S | AYN-KH---RDKPIREq-- | 1305 |
| WP_004636532 | 1212 | NRYDKVK------fPDSIE-YVHDNLAKFDDLLEYVIDFSNKYINAD--KNVQKIQ-K | IYK-EH---GTEDVEL-- | 1271 |
| WP_002364836 | 1218 | KQCLL------PNQ-SESLA-YVEQHQPEFQEILERVVDFAEVHTLAK--SKVQQIV-K | LFE-AN---QTADVKE-- | 1277 |
| WP_016631044 | 1169 | KQCLL------PNQ-SESLA-YVEQHQPEFQEILERVVDFAEVHTLAK--SKVQQIV-K | LFE-AN---QTADVKE-- | 1228 |
| EMS75795 | 954 | QHYDEIAhKESF-----D-YVNDHLSEFREILDQVIDFSNRYTIAA--KNTEKIA-E | QESTVQS-- | 1013 |
| WP_002373311 | 1218 | KQCLL------PNQ-SESLA-YVEQHQPEFQEILERVVDFAEVHTLAK--SKVQQIV-K | LFE-AN---QTADVKE-- | 1277 |
| WP_002378009 | 1218 | KQCLL------PNQ-SESLA-YVEQHQPEFQEILERVVDFAEVHTLAK--SKVQQIV-K | LFE-AN---QTADVKE-- | 1277 |
| WP_002407324 | 1218 | KQCLL------PNQ-SESLA-YVEQHQPEFQEILERVVDFAEVHTLAK--SKVQQIV-K | LFE-AN---QTADVKE-- | 1277 |
| WP_002413717 | 1218 | KQCLL------PNQ-SESLA-YVEQHQPEFQEILERVVDFAEVHTLAK--SKVQQIV-K | LFE-AN---QTADVKE-- | 1277 |
| WP_010775580 | 1220 | KQCLL------PNQ-SESLA-YVEQHQPEFQEILERVVDFAEVHTLAK--SKVQQIV-K | LFE-QN---QESTVQS-- | 1279 |
| WP_010818269 | 1218 | KQCLL------PNQ-SESLA-YVEQHQPEFQEILERVVDFAEVHTLAK--SKVQQIV-K | LFE-AN---QTADVKE-- | 1277 |
| WP_010824395 | 1218 | KQCLL------PNQ-SESLA-YVEQHQPEFQEILERVVDFAEVHTLAK--SKVQQIV-K | LFE-AN---QTADVKE-- | 1277 |
| WP_016622645 | 1218 | KQCLL------PNQ-SESLA-YVEQHQPEFQEILERVVDFAEVHTLAK--SKVQQIV-K | LFE-AN---QTADVKE-- | 1277 |
| WP_033624816 | 1218 | KQCLL------PNQ-SESLA-YVEQHQPEFQEILERVVDFAEVHTLAK--SKVQQIV-K | LFE-AN---QTADVKE-- | 1277 |
| WP_033625576 | 1218 | KQCLL------PNQ-SESLA-YVEQHQPEFQEILERVVDFAEVHTLAK--SKVQQIV-K | LFE-AN---QTADVKE-- | 1277 |
| WP_033789179 | 1218 | KQCLL------PNQ-SESLA-YVEQHQPEFQEILERVVDFAEVHTLAK--SKVQQIV-K | LFE-AN---QTADVKE-- | 1277 |
| WP_002310644 | 1220 | KQYDEIShKESF-----D-YVNEHHKEFSEVFARVLEFAGKYTLAE--KNIEKLE-K | IYK-EN---QTDDLAK-- | 1279 |
| WP_002112694 | 1221 | KQYDEIShKESF-----D-YVNEHHKEFSEVFARVLEFAGKYTLAE--KNIEKLE-K | IYY-EN---QTDDLAK-- | 1280 |
| WP_002314015 | 1221 | KQYDEIShKESF-----D-YVNTHLSDFSAILTEVLARAEKYTLAD--KNIERIQ-E | LYE-EN---QTDDLAK-- | 1280 |
| WP_002320716 | 1221 | KQYDEIShKESF-----D-YVNTHLSDFSAILTEVLARAEKYTLAE--KNIERIQ-E | LYE-EN---QTDDLAK-- | 1280 |
| WP_002330729 | 1220 | KQYDEIShKESF-----D-YVNTHLSDFSAILTEVLARAEKYTLAE--KNIERIQ-E | LYE-EN---QTDDLAK-- | 1279 |
| WP_002335161 | 1221 | KQYDEIShKESF-----D-YVNEHHKEFSEVFARVLEFAGKYTLAE--KNIERIQ-E | IYK-EN---QTDDLAK-- | 1280 |
| WP_002345439 | 1221 | KQYDEIShKESF-----D-YVNEHHKEFSEVFARVLEFAGKYTLAE--KNIEKLE-K | IYK-EN---QTDDLAK-- | 1280 |
| WP_034867970 | 1211 | QHYDKITyQESF-----D-YVNTHLSDFSAILTEVLARAEKYTLAD--KNIERIQ-E | LYE-TN---KYGETSM-- | 1270 |
| WP_047937432 | 1221 | QHYDKITyQESF-----D-YVNEHHKEFSEVFARVLEFAGKYTLAE--KNIEKLE-K | IYK-EN---QTDDLAK-- | 1280 |
| WP_010720994 | 1211 | QHYDKITyQESF-----D-YVNEHHKEFSEVFARVLEFAGKYTLAE--KNIERIQ-E | LYE-EN---KYGEISM-- | 1270 |
| WP_010733004 | 1211 | QHYDKITyQESF-----D-YVNTHLSDFSAILTEVLARAEKYTLAD--KNIERIQ-E | LYE-EN---KYGETSM-- | 1270 |
| WP_010733004 | 1211 | QHYDKITyQESF-----D-YVNTHLSDFSAILTEVLARAEKYTLAD--KNIERIQ-E | LYE-EN---KYGETSM-- | 1270 |
| WP_048604708 | 1214 | QHYDKITyQESF-----D-YVNEHSNFQDILDKVIIFAEKYTSAP--QKLNQII-A | TYE-KN---QEADRKI-- | 1273 |
| WP_010750235 | 1209 | KKIIN--gKNSD----SVS-YIQNNKEKPREIFEYIVDFSSKVISAD--ANLDKVL-S | IPE-NNfh---KASEge | 1269 |
| AII16583 | 1279 | RHYDEINhKVSF-----D-YVNAHKEGENDIFDFISDEGVRYIIAP--QHLEKIK-V | AYB-KN---KEVDLKE-- | 1344 |
| WP_023519017 | 1205 | KQVDE----DS-GKSEE-YVREHRAEFAEILNYVQAFSETKILAN--KNLQTIL-K | LYE-EN---KRADIKE-- | 1264 |
| WP_010770040 | 1216 | KHCNE----KP-D-SLK-YVTEHQSGFSEIMAHVKDEKEYYTLVD--KNLEKIL-S | LYA-KN---MDSEVKE-- | 1274 |
| WP_031589969 | 1213 | NHYDEIAyKDSY-----D-YVNEHSNFQDILDKVIIFAEKYTSAP--QKLNQII-A | TYE-KN---QEADRKI-- | 1273 |
| KDA45870 | 1200 | NAKDG-----EQKLE-DHKAEFKELFDKIMEFADKVVAP--KNSEKIR-R | LYE-ENq----DATPme | 1253 |
| WP_039099354 | 1242 | LPLTQ-----SEeLAEQV-----YIESNREMFAELLAHVSEFAKRYTLAE--ANLNKIN-Q | DGN-KMv-----QVGQqv | 1306 |
| AKP02966 | 1238 | QIPDE-----DpDQILaF-YDKNILVEILQELITKMKKFYPFY--KNEQEFLaS | FNQ-------ATTSEk-- | 1296 |
| WP_010991369 | 1216 | ANCEV-----SD-GKSLD-YIESNREMFAELLAHVSEFAKRYTLAE--ANLNKIN-Q | LFE-QN---KEGDIKA-- | 1274 |
| WP_033838504 | 1216 | ANCEV-----SD-GKSLD-YIESNREMFAELLAHVSEFAKRYTLAE--ANLNKIN-Q | LFE-QN---KEGDIKA-- | 1274 |
| EHN60060 | 1219 | ANCEV-----SD-GKSLD-YIESNREMFAELLAHVSEFAKRYTLAE--ANLNKIN-Q | LFE-QN---KEGDIKA-- | 1277 |

```
                                              -continued

EFR89594           985  ANCEV------SD-GKSLD--YIESNREMFAELLAHVSEFAKRYTLAE--ANLNKIN-Q  LFE-QN----KEGDIKA-  1043
WP_038409211      1216  KNCEA------ND-GESLA--YIEMHREMFAELLAYISEFAKRYTLAN--DRLEKIN-M  PFE-QN----KKGDIKV-  1274
EFR95520           835  KNCEA------ND-GESLA--YIEMHREMFAELLAYISEFAKRYTLAN--ANLEKIN-N  LFE-QN----KEGDIKA-   893
WP_003723650      1216  KNCEA------SD-GKSLK--YIEAHRETFSELLAQVSEFAKRYTLAD--ANLSKIN-N  LFE-QN----KEGDIKA-  1274
WP_003727705      1216  KNCEA------SD-GKSLK--YIEAHRETFSELLAQVSEFATKYTLAD--ANLSKIN-N  LFE-QN----KEGDIKA-  1274
WP_003730785      1216  KNCEA------SD-GKSLK--YIEAHRETFSELLAQVSEFATKYTLAD--ANLSKIN-N  LFE-QN----KEGDIKA-  1274
WP_003733029      1216  EKYEA------ID-GESLA--YIEVHRALFDELLAYISEFAKRYTLSN--DRLDEIN-M  LYE-RN----KDGDVKS-  1274
WP_003739838      1216  KNCEA------SD-GKSLD--YIESNREMFGELLAHVSEFARKYTLAN--ANLSKIN-Q  LFE-QN----KDNDIKV-  1274
WP_014601172      1216  KNCEA------SD-GKSLK--YIEAHRETFSELLAQVSEFATRYTLAD--ANLSKIN-N  LFE-QN----KEGDIQA-  1274
WP_023548323      1216  EKREA------ID-GESLA--YIEAHKAVFGELLAHISEFARKYTLAN--DKLDEIN-M  LYE-RN----KDGDVKS-  1274
WP_031665337      1216  KNCEA------ID-GESLA--YIEAHKAVFGELLAHISEFARKYTLAN--ANLSKIN-N  LFE-RN----KDGDIKA-  1274
WP_031669209      1216  EKYEA------ID-GESLA--YIEVHRALFDELLAYISEFARKYTLSN--DRLDEIN-M  LYE-RN----KDGDVKS-  1274
WP_033920898      1216  KNCEA------SD-GKSLK--YIEAHRETFSELLAQVSEFATRYTLAD--DKLDEIN-M  LYE-RN----KDGDVKS-  1274
AKI42028          1219  KNCEA------SD-GKSLK--YIEAHRETFSELLAQVSEFATRYTLAD--ANLSKIN-N  LFE-QN----KEGDIQA-  1277
AKI50529          1219  EKREA------ID-GESLA--YIEAHKAVFGELLAHISEFARKYTLAN--DKLDEIN-M  LYE-RN----KDGDVKS-  1277
EFR83390           664  KNCEA------SD-GKSLK--YIEAHRETFSELLAQVSEFATRYTLAD--ANLSKIN-X  LFE-QN----KEGDIKX-   722
WP_046323366      1216  KNCEA------SD-GKSLA--YIESHREMFAELLDSISEFASRYTLAD--ANLEKIN-T  IFE-QN----KSGDVKV-  1274
AKE81011          1256  SHYEKLKgsPEDnEQKQL--FVEQHKHYLDEIIEQISEFSKRVILAD--ANLDKVL-S  AYN-KH----RDKPIREq  1321
CUO82355          1216  YNAIYKQ-DFDGIDNMLMi-------------QLYLQLIDKLKTLYPIY-mGIVEKPE-K  FVS-------SKEEK---  1272
WP_033162887      1218  YAAMLKK-RYEYIDEEEIf---------DLYLQLLQKMDTLYPAY-kGIAKRPE-D  FKN-------i----DVVEk  1274
AGZ01981          1273  SHYEKLKgsPEDnEQKQL--FVEQHKHYLDEIIEQISEFSKRVILAD--ANLDKVL-S  AYN-KH----RDKPIREq  1338
AKA60242          1240  SHYEKLKgsPEDnEQKQL--FVEQHKHYLDEIIEQISEFSKRVILAD--ANLDKVL-S  AYN-KH----RDKPIREq  1305
AKS40380          1240  SHYEKLKgsPEDnEQKQL--FVEQHKHYLDEIIEQISEFSKRVILAD--ANLDKVL-S  AYN-KH----RDKPIREq  1305
4UN5_B            1244  SHYEKLKgsPEDnEQKQL--FVEQHKHYLDEIIEQISEFSKRVILAD--ANLDKVL-S  AYN-KH----RDKPIREq  1309

WP_010922251      1306  HLFTLTNLGAP-AAFKYFD-[T]I--DRK--R-YTSTKECL  DATLIHQSITGLYETRIDLSQL-  1365

WP_039695303      1309  NLLTLTALGAP-ADFNFLG--EKI--PRK--R-YTSTKECL  NATLIHQSITGLYETRIDLSKL-  1369
WP_045635197      1307  LAN---SFI  NLLTFTALGAP-AAFKFFG--KDI--PRK--R-YTTVSEIL  NATLIHQSITGLYETWIDLSKL-  1367
5AXW_A                  -----                       ---------                         --------------------   
WP_009880683       990  -AE---NII  HLFTLTNLGAP-AAFKCFD--TTI--GRN--R-YKSIKEVL  DATLIHQSITGLYETRIDLSQL-  1049
WP_010922251      1306  -AE---NII  HLFTLTNLGAP-AAFKYFD--TTI--DRK--R-YTSTKEVL  DATLIHQSITGLYETRIDLSQL-  1365
WP_011054416      1306  -AE---NII  HLFTLTNLGAP-AAFKYFD--TTI--DRK--R-YKSIKEVL  DATLIHQSITGLYETRIDLSQL-  1365
WP_011284745      1306  -AE---NII  HLFTLTNLGAP-AAFKYFD--TTI--DRK--R-YKSIKEVL  DATLIHQSITGLYETRIDLSQL-  1365
WP_011285506      1306  -AE---NII  HLFTLTNLGAP-TAFKYFD--TTI--DRK--R-YKSIKEVL  DATPIHQSITGLYETRIDLSQL-  1365
WP_011527619      1306  -AE---NII  HLFTLTNLGAP-AAFKYFD--TTI--DRK--R-YKSIKEVL  DATPIHQSITGLYETRIDLSQL-  1365
WP_012560673      1305  -AE---NII  HLFTLTNLGAP-AAFKCFD--TTI--GRN--R-YKSIKEVL  DATLIHQSITGLYEIRIDLSQL-  1364
WP_014407541      1306  -AE---NII  HLFTLTNLGAP-AAFKYFD--TTI--DRK--R-YKSIKEVL  DATLIHQSITGLYETRIDLSQL-  1365
WP_020905136      1305  -AK---NII  HLFTLTNLGAP-AAFKYFD--TTI--ERN--R-YKSIKEVL  DATLIHQSITGLYETRIDLSQL-  1364
WP_023080005      1305  -AE---NII  HLFTLTNLGAP-AAFKYFD--TTI--ERN--R-YKSIKEVL  DATLIHQSITGLYETRIDLSQL-  1364
WP_023610282      1306  -AE---NII  HLFTLTNLGAP-AAFKFFG--KDI--PRK--R-YTSTKEVL  DATLIHQSITGLYETRIDLSQL-  1365
WP_030125963      1306  -AE---NII  HLFTLTNLGAP-AAFKYFD--TTI--DRK--R-YKSIKEVL  DATLIHQSITGLYETRIDLSQL-  1365
WP_030126706      1306  -AE---NII  HLFTLTNFGAP-AAFIYFD--TTI--GRN--R-YKSIKEVL  DATLIHQSITGLYETRIDLSQL-  1365
WP_031488318      1306  -AE---NII  HLFTLTNLGAP-AAFKYFD--TTI--DRK--R-YKSIKEVL  DATLIHQSITGLYETRIDLSQL-  1365
WP_032460140      1306  -AE---NII  HLFTLTNLGAP-AAFKYFD--TTI--GRN--R-YKSIKEVL  DATLIHQSITGLYETRIDLSQL-  1365
WP_032461047      1306  -AE---NII  HLFTLTNLGAP-AAFKYFD--TTI--DRK--R-YKSIKEVL  DATLIHQSITGLYETRIDLSQL-  1365
WP_032462016      1306  -AE---NII  HLFTLTNLGAP-AAFKYFD--TTI--DRK--R-YKSIKEVL  DATLIHQSITGLYETRIDLSQL-  1365
WP_032462936      1306  -AE---NII  HLFTLTNLGAP-AAFKYFD--TTI--DRK--R-YKSIKEVL  DATLIHQSITGLYETRIDLSQL-  1365
WP_032464890      1306  -AE---NII  HLFTLTNLGAP-AAFKYFD--TTI--DRK--R-YKSIKEVL  DATPIHQSITGLYETRIDLSQL-  1365
WP_033888930      1131  -AK---NII  HLFTLTNLGAP-AAFKYFD--TTI--DRK--R-YKSIKEVL  DATLIHQSITGLYETRIDLSQL-  1190
WP_038431314      1306  -AE---NII  HLFTLTNLGAP-AAFKYFD--TTI--DRK--R-YKSIKEVL  DATLIHQSITGLYETRIDLSQL-  1365
WP_038432938      1305  -AK---NII  HLFTLTNLGAP-AAFKYFD--TTI--ERN--R-YKSIKEVL  DATLIHQSITGLYETRIDLSQL-  1364
WP_038434062      1306  -AE---NII  HLFTLTNLGAP-AAFKYFD--TTI--DRK--R-YKSIKEVL  DATLIHQSITGLYETRIDLSQL-  1365
BAQ51233          1217  -AE---NII  HLFTLTNLGAP-AAFKYFD--TTI--GRN--R-YKSIKEVL  DATLIHQSITGLYETRIDLSQL-  1276
```

| | | | | | |
|---|---|---|---|---|---|
| KGE60162 | 481 | -AE---NII | HLFTLTNLGAP-AAFKYFD--TTI--DRK--R--YTSTKEVL | DATLIHQSITGLYETRIDLSQL-- | 540 |
| KGE60856 | 244 | -AE---NII | HLFTLTNLGAP-AAFKYFD--TTI--DRK--R--YTSTKEVL | DATLIHQSITGLYETRIDLSQL-- | 303 |
| WP_002989955 | 1306 | -AE---NII | HLFTLTNLGAP-TAFKYFD--TTI--DRK--R--YTSTKEVL | DATFIHQSITGLYETRIDLSQL-- | 1365 |
| WP_003030002 | 1282 | LAK---SFI | SLLTFTAPGAP-AAFNFPG--ENI--DRK--R--YTSVTECL | NATLIHQSITGLYETRIDLSKL-- | 1342 |
| WP_003065552 | 1310 | ISN---SFI | NLLTLTALGAP-ADFNFLG--EKI--PRK--R--YTSTKECL | NATLIHQSITGLYETRIDLSKI-- | 1370 |
| WP_001040076 | 1315 | LAN---NII | NLFTFTSLGAP-AAFKFFD--KIV--DRK--R--YTSTKEVL | NSTLIHQSITGLYETRIDLSKL-- | 1375 |
| WP_001040078 | 1307 | LAN---NII | NLFTFTSLGAP-AAFKFFD--KIV--DRK--R--YTSTKEVL | NSTLIHQSITGLYETRIDLGKL-- | 1367 |
| WP_001040080 | 1307 | LAN---NII | NLFTFTSLGAP-AAFKFFD--KIV--DRK--R--YTSTKEVL | NSTLIHQSITGLYETRIDLGKL-- | 1367 |
| WP_001040081 | 1307 | LAN---NII | NLFTFTSLGAP-AAFKFFD--KIV--DRK--R--YTSTKEVL | NSTLIHQSITGLYETRIDLGKL-- | 1367 |
| WP_001040083 | 1307 | LAN---NII | NLFTFTSLGAP-AAFKFFD--KIV--DRK--R--YTSTKEVL | NSTLIHQSITGLYETRIDLGKL-- | 1367 |
| WP_001040085 | 1307 | LAN---NII | NLFTFTSLGAP-AAFKFFD--KIV--DRK--R--YTSTKEVL | NSTLIHQSITGLYETRIDLGKL-- | 1367 |
| WP_001040087 | 1307 | LAN---NII | NLFTFTSLGAP-AAFKFFD--KIV--DRK--R--YTSTKEVL | NSTLIHQSITGLYETRIDLGKL-- | 1367 |
| WP_001040088 | 1307 | LAN---NII | NLFTFTSLGAP-AAFKFFD--KIV--DRK--R--YTSTKEVL | NSTLIHQSITGLYETRIDLGKL-- | 1367 |
| WP_001040089 | 1307 | LAN---NII | NLFTFTSLGAP-AAFKFFD--KIV--DRK--R--YTSTKEVL | NSTLIHKSITGLYETRIDLGKL-- | 1367 |
| WP_001040090 | 1307 | LAN---NII | NLFTFTSLGAP-AAFKFFD--KIV--DRK--R--YTSTKEVL | NSTLIHQSITGLYETRIDLGKL-- | 1367 |
| WP_001040091 | 1307 | LAN---NII | NLFTFTSLGAP-AAFKFFD--KIV--DRK--R--YTSTKEVL | NSTLIHQSITGLYETRIDLGKL-- | 1367 |
| WP_001040092 | 1307 | LAK---NII | NLFTFTSLGAP-AAFKFFD--KSV--DRK--R--YTSTKEVL | DSTLIHQSITGLYETRIDLGKL-- | 1367 |
| WP_001040094 | 1307 | LAN---NII | NLFTFTSLGAP-AAFKFFD--KIV--DRK--R--YTSTKEVL | NSTLIHQSITGLYETRIDLGKL-- | 1367 |
| WP_001040095 | 1307 | LAN---NII | NLFTFTSLGAP-AAFKFFD--KIV--DRK--R--YTSTKEVL | NSTLIHQSITGLYETRIDLGKL-- | 1367 |
| WP_001040096 | 1307 | LAN---NII | NLFTFTSLGAP-AAFKFFD--KIV--DRK--R--YTSTKEVL | NSTLIHQSITGLYETRIDLGKL-- | 1367 |
| WP_001040097 | 1307 | LAN---NII | NLFTFTSLGAP-AAFKFFD--KIV--DRK--R--YTSTKEVL | NSTLIHQSITGLYETRIDLGKL-- | 1367 |
| WP_001040098 | 1307 | LAN---NII | NLFTFTSLGAP-AAFKFFD--KIV--DRK--R--YTSTKEVL | NSTLIHQPITGLYETRIDLGKL-- | 1367 |
| WP_001040099 | 1307 | LAN---NII | NLFTFTSLGAP-AAFKFFD--KIV--DRK--R--YTSTKEVL | NSTLIHQSITGLYETRIDLGKL-- | 1367 |
| WP_001040100 | 1307 | LAN---NII | NLFTFTSLGAP-AAFKFFD--KIV--DRK--R--YTSTKEVL | DSTLIHQSITGLYETRIDLGKL-- | 1367 |
| WP_001040104 | 1307 | LAN---NII | NLFTFTSLGAP-AAFKFFD--KIV--DRK--R--YTSTKEVL | NSTLIHQSITGLYETRIDLGKL-- | 1367 |
| WP_001040105 | 1307 | LAN---NII | NLFTFTSLGAP-AAFKFFD--KIV--DRK--R--YTSTKEVL | NSTLIHQSITGLYETRIDLGKL-- | 1367 |
| WP_001040106 | 1307 | LAN---NII | NLFTFTSLGAP-AAFKFFD--KIV--DRK--R--YTSTKEVL | NSTLIHQSITGLYETRIDLGKL-- | 1367 |
| WP_001040107 | 1307 | LAN---NII | NLFTFTSLGAP-AAFKFFD--KIV--DRK--R--YTSTKEVL | NSTLIHQSITGLYETRIDLGKL-- | 1367 |
| WP_001040108 | 1307 | LAN---NII | NLFTFTSLGAP-AAFKFFD--KIV--DRK--R--YTSTKEVL | NSTLIHQSITGLYETRIDLGKL-- | 1367 |
| WP_001040109 | 1307 | LAN---NII | NLFTFTSLGAP-AAFKFFD--KIV--DRK--R--YTSTKEVL | NSTLIHQSITGLYETRIDLGKL-- | 1367 |
| WP_001040110 | 1307 | LAK---NII | NLFTFTSLGAP-AAFKFFD--KSV--DRK--R--YTSTKEVL | DSTLIHQSITGLYETRIDLGKL-- | 1367 |
| WP_015058523 | 1307 | LAN---NII | NLFTFTSLGAP-AAFKFFD--KIV--DRK--R--YTSTKEVL | NSTLIHQSITGLYETRIDLGKL-- | 1367 |
| WP_017643650 | 1307 | LAN---NII | NLFTFTSLGAP-AAFKFFD--KIV--DRK--R--YTSTKEVL | NSTLIHQSITGLYETRIDLGKL-- | 1367 |
| WP_017647151 | 1307 | LAN---NII | NLFTFTSLGAP-AAFKFFD--KIV--DRK--R--YTSTKEVL | NSTLIHQSITGLYETRIDLGKL-- | 1367 |
| WP_017648376 | 1307 | LAN---NII | NLFTFTSLGAP-AAFKFFD--KIV--DRK--R--YTSTKEVL | NSTLIHQSITGLYETRIDLGKL-- | 1367 |
| WP_017649527 | 1307 | LAN---NII | NLFTFTSLGAP-AAFKFFD--KIV--DRK--R--YTSTKEVL | NSTLIHQSITGLYETRIDLGKL-- | 1367 |
| WP_017771611 | 1307 | LAN---NII | NLFTFTSLGAP-AAFKFFD--KIV--DRK--R--YTSTKEVL | NSTLIHQSITGLYETRIDLGKL-- | 1367 |
| WP_017771984 | 1307 | LAN---NII | NLFTFTSLGAP-AAFKFFD--KIV--DRK--R--YTSTKEVL | NSTLIHQSITGLYETRIDLGKL-- | 1367 |
| CFQ25032 | 1307 | LAN---NII | NLFTFTSLGAP-AAFKFFD--KIV--DRK--R--YTSTKEVL | NSTLIHQSITGLYETRIDLGKL-- | 1367 |
| CFV16040 | 1307 | LAN---NII | NLFTFTSLGAP-AAFKFFD--KIV--DRK--R--YTSTKEVL | NSTLIHQSITGLYETRIDLGKL-- | 1367 |
| KLJ37842 | 1307 | LAN---NII | NLFTFTSLGAP-AAFKFFD--KIV--DRK--R--YTSTKEVL | NSTLIHQSITGLYETRIDLGKL-- | 1367 |
| KLJ72361 | 1321 | LAN---NII | NLFTFTSLGAP-AAFKFFD--KIV--DRK--R--YTSTKEVL | NSTLIHQSITGLYETRIDLGKL-- | 1381 |
| KLL20707 | 1307 | LAN---NII | NLFTFTSLGAP-AAFKFFD--KIV--DRK--R--YTSTKEVL | NSTLIHQSITGLYETRIDLGKL-- | 1367 |
| KLL42645 | 1307 | LAN---NII | NLFTFTSLGAP-AAFKFFD--KIV--DRK--R--YTSTKEVL | NSTLIHQSITGLYETRIDLGKL-- | 1367 |
| WP_047072273 | 1307 | LAN---NII | NLFTFTSLGAP-AAFKFFD--KIV--DRK--R--YTSTKEVL | NSTLIIHKSITGLYETRIDLGKL-- | 1367 |
| WP_047209694 | 1307 | LAN---NII | NLFTFTSLGAP-AAFKFFD--KIV--DRK--R--YTSTKEVL | NSTLIHQSITGLYETRIDLGKL-- | 1367 |
| WP_050198062 | 1307 | LAN---NII | NLFTFTSLGAP-AAFKFFD--KIV--DRK--R--YTSTKEVL | NSTLIHQSITGLYETRIDLGKL-- | 1367 |
| WP_050201642 | 1307 | LAN---NII | NLFTFTSLGAP-AAFKFFD--KII--DRK--R--YTSTKEVL | NSTLIHQSITGLYETRIDLGKL-- | 1367 |
| WP_050204027 | 1307 | LAN---NII | NLFTFTSLGAP-AAFKFFD--KIV--DRK--R--YTSTKEVL | NSTLIHQSITGLYETRIDLGKL-- | 1367 |
| WP_050881965 | 1307 | LAK---NII | NLFTFTSLGAP-AAFKFFD--KSV--DRK--R--YTSTKEVL | DSTLIHQSITGLYETRIDLGKL-- | 1367 |
| WP_050886065 | 1307 | LAN---NII | NLFTFTSLGAP-AAFKFFD--KIV--DRK--R--YTSTKEVL | NSTLIHQSITGLYETRIDLGKL-- | 1367 |
| AHN30376 | 1307 | LAN---NII | NLFTFTSLGAP-AAFKFFD--KIV--DRK--R--YTSTKEVL | NSTLIHQSITGLYETRIDLGKL-- | 1367 |
| EAO78426 | 1307 | LAN---NII | NLFTFTSLGAP-AAFKFFD--KIV--DRK--R--YTSTKEVL | NSTLIHQSITGLYETRIDLGKL-- | 1367 |
| CCW42055 | 1307 | LAN---NII | NLFTFTSLGAP-AAFKFFD--KIV--DRK--R--YTSTKEVL | NSTLIHQSITGLYETRIDLGKL-- | 1367 |

-continued

```
WP_003041502  1314  ICT---SFL  GLFELTSLGSA-SDFEFLG-VKI-PRY-RdYTPSSLLK  DSTLIHQSITGLYETRIDLSKL-  1383
WP_037593752  1283  LAK---SFI  SLLTFTAFGAP-AAFNFFG-ENI-DRK-R-YTSVTECL  NATLIHQSITGLYETRIDLSKL-  1343
WP_049516684  1282  LAK---SFI  SLLTFTAFGAP-AAFNFFG-ENI-DRK-R-YTSVTECL  NATLIHQSITGLYETRIDLSKL-  1342
GAD46167      1314  ISD---SFI  SLLTFTALGAP-ADFNFLG-EKI-PRK-R-YNSTKECL  NATLIHQSITGLYETRIDLSKL-  1374
WP_018363470  1311  -SN---SFV  SLLKYTSFGAS-GGFTFLD-LDVkqGRL-R-YQTVTEVL  DATLIYQSITGLYETRIDLSQL-  1372
WP_003043819  1282  LAK---SFI  SLLTFTAFGAP-AAFNFFG-EKI-DRK-R-YTSTECL   NATLIHQSITGLYETRIDLSKL-  1342
WP_006269658  1302  ISN---SFI  HLLTLTAIGAP-ADFKFLG-EKI-PRK-R-YGSPQSIL  NATLIHQSTGLYETQTRIDLSKL-  1362
WP_048800089  1309  -CS---SVI  NLLTLTASGAP-ADFKFLG-TTI-PRK-R-YGSPQSIL  SSTLIHQSITGLYETRIDLSQL-  1368
WP_012767106  1309  -CS---SVI  NLLTLTASGAP-ADFKFLG-TTI-PRK-R-YGSPQSIL  SSTLIHQSITGLYETRIDLSQL-  1368
WP_014612333  1309  -CS---SVI  NLLTLTASGAP-ADFKFLG-TTI-PRK-R-YGSPQSIL  SSTLIHQSITGLYETRIDLSQL-  1368
WP_015017095  1309  -CS---SVI  NLLTLTASGAP-ADFKFLG-TTI-PRK-R-YGSPQSIL  SSTLIHQSITGLYETRIDLSQL-  1368
WP_048327215  1309  -CS---SVI  NLLTLTASGAP-ADFKFLG-TTI-PRK-R-YGSPQSIL  SSTLIHQSITGLYETRIDLSQL-  1368
WP_049519324  1286  -AE---NII  NVFTFVALGAP-AAFKFFD-ATI-PRK-R-YTSTKEVL  NATLIHQSVTGLYETRIDLSQL-  1345
WP_012515931  1286  -AE---NII  NVFTFVALGAP-AAFKFFD-ATI-DRK-R-YTSTKEVL  NATLIHQSITGLYETRIDLSQL-  1345
WP_021320964  1286  -AE---NII  NVFTFVALGAP-AAFKFFD-ATI-DRK-R-YTSTKEVL  NATLIHQSITGLYETRIDLSQL-  1345
WP_037581760  1309  ISSlseSFI  NLLKFISFGAP-GAFKFLK-LDV--KQSnlR-YKSTTEAL  SATLIHQSVTGLYETRIDLSQL-  1374
WP_044232481  1307  ISN---SFI  NLLTLTAIGAP-ADFNFLG-EKI-PRK-R-YTSTKECL  TATLIHQSITGLYETRIDLSKL-  1367
WP_009854540  1308  ISI---SFV  NLLTLTAIGAP-ADFNFLG-EKI-PRK-R-YTSTKECL  NATLIHQSITGLYETRIDLNKL-  1368
WP_012962174  1309  ISN---SFI  NLLTLTALGAP-ADFNFLG-EKI-PRK-R-YTSTKECL  NATLIHQSITGLYETRIDLSKL-  1369
WP_039995303  1312  ISA---SFI  NLFTFTDLGAP-SAFKFFN-GDI-DRK-R-YSSTNEII  SATLIHQSVTGLYETRIDLSKL-  1372
WP_014334983  1306  -AI---NML  -------------------------------------  NSTLIYQSPTGLYETRIDLSKL-  1365
WP_030992269
AHY15608
AHY17476      138   ------NML  NLFTFTDLGAP-SAFKFFNg-DI--DRK-R-YSSTNEII  NSTLIYQSPTGLYETRIDLSRL-  197
ESR09100      1282  -AI---SFI  NLLTFTAIGAP-AAFKFFD-NNI-DRK-R-YTPYRA-   NSTLIHQSITGLYETRIDLSRL-  1342
AGM98575      1290  LAS---SFV  -LLNFTMMGAA-TDFKFFG-QII-PRK-R-YPSTTECL  KSTLIHQSVTGLYETRIDLSKL-  1350
ALF27331      1311  VAR---SFV  SLLKLISFGAP-GTFKFLG-VEI-SQSnvR-YQSVSSCF  NATLIHQSITGLYETWIDLSKL-  1373
WP_018372492  1307  LSE---SFI  NLLTFTALGAP-AAFKFFG-KDI-DRK-R-YTTVSEIL  NATLIHQSITGLYETRIDLNKL-  1367
WP_045618028  1282  LAN---SFI  NLLTFTAIGAP-ATFKFFD-KNI-DRK-R-YTSTTEIL  NATLIHQSITGLYETRIDLSKL-  1342
WP_045635197  1282  LAS---SFI  NLLTFTAIGAP-ATFKFFD-KNI-DRK-R-YTSTTEIL  NATLIHQSITGLYETRIDLSKL-  1342
WP_002263549  1282  LAS---SFI  NLLTFTAIGAP-ATFKFFD-KNI-DRK-R-YTSTTEIL  NATLIHQSITGLYETRIDLSKL-  1342
WP_002263887  1282  LAS---SFI  NLLTFTAIGAP-ATFKFFD-KNI-DRK-R-YTSTTEIL  NATLIHQSITGLYETRIDLSKL-  1342
WP_002264920  1282  LAS---SFI  NLLTFTAIGAP-ATFKFFD-KNI-DRK-R-YTSTTEIL  NATLIHQSITGLYETRIDLSKL-  1342
WP_002269043  1282  LAS---SFI  NLLTFTAIGAP-ATFKFFD-KNI-DRK-R-YTSTTEIL  NATLIHQSITGLYETRIDLSKL-  1342
WP_002269448  1282  LAS---SFI  NLLTFTAIGAP-ATFKFFD-KNI-DRK-R-YTSTTEIL  NATLIHQSITGLYETRIDLSKL-  1342
WP_002271977  1282  LAS---SFI  NLLTFTAIGAP-ATFKFFD-KNI-DRK-R-YTSTTEIL  NATLIHQSITGLYETRIDLSKL-  1342
WP_002272766  1282  LAS---SFI  NLLTFTAIGAP-ATFKFFD-KNI-DRK-R-YTSTTEIL  NATLIHQSITGLYETRIDLSKL-  1342
WP_002273241  1282  LSS---SFI  NLLTFTAIGAP-ATFKFFD-KNI-DRK-R-YTSTTEIL  NATLIHQSITGLYETRIDLSKL-  1342
WP_002275430  1282  LAS---SFI  NLLTFTAIGAP-ATFKFFD-KNI-DRK-R-YTSTTEIL  NATLIHQSITGLYETRIDLSKL-  1342
WP_002276448  1288  LAD---GFI  KLLGFTQLGAT-SPFSFIG-IKL-NQK-Q-YTGKKDYL  EATLIHQSITGLYETRIDLSKL-  1352
WP_002277050  1282  LAS---SFI  NLLTFTAIGAP-ATFKFFD-KNI-DRK-R-YTSTTEIL  NATLIHQSITGLYETRIDLSKL-  1342
WP_002273364  1282  LAS---SFI  NLLTFTAIGAP-ATFKFFD-KNI-DRK-R-YTSTTEIL  NATLIHQSITGLYETRIDLSKL-  1342
WP_002279025  1282  LAS---SFI  NLLTFTAIGAP-ATFKFFD-KNI-DRK-R-YTSTTEIL  NATLIHQSITGLYETRIDLSKL-  1342
WP_002279859  1282  LAS---SFI  NLLTFTAIGAP-ATFKFFD-KNI-DRK-R-YTSTTEIL  NATLIHQSITGLYETRIDLSKL-  1342
WP_002280230  1282  LAS---SFI  NLLTFTAIGAP-ATFKFFD-KNI-DRK-R-YTSTTEIL  NATLIHQSITGLYETRIDLSKL-  1342
WP_002281696  1288  LAD---GFI  KLLGFTQLGAT-SPFSFIG-IKL-NQK-Q-YTGKKDYL  EATLIHQSITGLYETRIDLSKL-  1352
WP_002282247  1282  LAS---SFI  NLLTFTAIGAP-ATFKFFD-KNI-DRK-R-YTSTTEIL  NATLIHQSITGLYETRIDLSKL-  1342
WP_002282906  1282  LAD---GFI  KLLGFTQLGAT-SPFSFIG-IKL-NQK-Q-YTGKKDYL  EATLIHQSITGLYETRIDLSKL-  1352
WP_002283846  1282  LAS---SFI  NLLTFTAIGAP-ATFKFFD-KNI-DRK-R-YTSTTEIL  NATLIHQSITGLYETRIDLSKL-  1342
WP_002872255  1282  LAS---SFI  NLLTFTAIGAP-ATFKFFD-KNI-DRK-R-YTSTTEIL  NATLIHQSITGLYETRIDLSKL-  1342
WP_002288990  1282  LAS---SFI  NLLTFTAIGAP-ATFKFFD-KNI-DRK-R-YTSTTEIL  NATLIHQSITGLYETRIDLSKL-  1342
WP_002289641  1282  LAS---SFI  NLLTFTAIGAP-ATFKFFD-KNI-DRK-R-YTSTTEIL  NATLIHQSITGLYETRIDLSKL-  1342
WP_002290427  1282  LAS---SFI  NLLTFTAIGAP-ATFKFFD-KNI-DRK-R-YTSTTEIL  NATLIHQSITGLYETRIDLSKL-  1342
```

| | | | | |
|---|---|---|---|---|
| WP_002295753 | 1282 | LAS---SFI | NLLTFTAIGAP-AAFKFFD--KNI--DRK--R-YTSTTEIL | NAATLIHQSITGLYETRIDLSKL- | 1342 |
| WP_002296423 | 1282 | LAS---SFI | NLLTFTAIGAP-ATFKFFD--KNI--DRK--R-YTSTTEIL | NATLIHQSITGLYETRIDLSKL- | 1342 |
| WP_002304487 | 1296 | LAS---SFI | NLLTFTAIGAP-AAFKFFD--KNI--DRK--R-YTSTTEIL | NATLIHQSITGLYETRIDLSKL- | 1356 |
| WP_002305844 | 1282 | LAS---SFI | NLLTFTAIGAP-ATFKFFD--KNI--DRK--R-YTSTTEIL | NATLIHQSITGLYETRIDLNKL- | 1342 |
| WP_002307203 | 1282 | LAS---SFI | NLLTFTAIGAP-ATFKFFD--KNI--DRK--R-YTSTTEIL | NATLIHQSITGLYETRIDLSKL- | 1342 |
| WP_002310390 | 1282 | LAS---SFI | NLLTFTAIGAP-ATFKFFD--KNI--DRK--R-YTSTTEIL | NATLIHQSITGLYETRIDLSKL- | 1342 |
| WP_002352408 | 1282 | LAS---SFI | NLLTFTAIGAP-ATFKFFD--KNI--DRK--R-YTSTTEIL | NATLIHQSITGLYETRIDLSKL- | 1342 |
| WP_012997688 | 1282 | LAS---SFI | NLLTFTAIGAP-ATFKFFD--KNI--DRK--R-YTSTTEIL | NATLIHQSITGLYETRIDLSKL- | 1342 |
| WP_014677909 | 1282 | LAS---SFI | NLLTFTAIGAP-ATFKFFD--KNI--DRK--R-YTSTTEIL | NATLIHQSITGLYETRIDLSKL- | 1342 |
| WP_019312892 | 1282 | LAS---SFI | NLLTFTAIGAP-ATFKFFD--KNI--DRK--R-YTSTTEIL | NATLIHQSITGLYETRIDLSKL- | 1342 |
| WP_019313659 | 1282 | LAS---SFI | NLLTFTAIGAP-ATFKFFD--KNI--DRK--R-YTSTTEIL | NATLIHQSITGLYETRIDLSKL- | 1342 |
| WP_019314093 | 1282 | LAS---SFI | NLLTFTAIGAP-ATFKFFD--KNI--DRK--R-YTSTTEIL | NATLIHQSITGLYETRIDLNKL- | 1342 |
| WP_019315370 | 1282 | LSS---SFI | NLLTFTAIGAP-ATFKFFD--KNI--DRK--R-YTSTTEIL | NATLIHQSITGLYETRIDLNKL- | 1342 |
| WP_019803776 | 1282 | LAS---SFI | NLLTFTAIGAP-ATFKFFD--KNI--DRK--R-YTSTTEIL | NATLIHQSITGLYETRIDLSKL- | 1342 |
| WP_019805234 | 1282 | LAS---SFI | NLLTFTAIGAP-ATFKFFD--KNI--DRK--R-YTSTTEIL | NATLIHQSITGLYETRIDLNKL- | 1342 |
| WP_024783594 | 1282 | LAS---SFI | NLLTFTAIGAP-ATFKFFD--KNI--DRK--R-YTSTTEIL | NATLIHQSITGLYETRIDLNKL- | 1342 |
| WP_024784288 | 1288 | LAD---GFI | KLLGFTQLGAT-SPFSFLG--IKL--NQK--Q-YTGKKDYL | EATLIHQSITGLYETRIDLSKL- | 1352 |
| WP_024784666 | 1282 | LAS---SFI | NLLTFTAIGAP-ATFKFFD--KNI--DRK--R-YTSTTEIL | NATLIHQSITGLYETRIDLSKL- | 1342 |
| WP_024784894 | 1282 | LAS---SFI | NLLTFTAIGAP-ATFKFFD--KNI--DRK--R-YTSTTEIL | NATLIHQSITGLYETRIDLSKL- | 1342 |
| WP_024786433 | 1288 | LAD---GFI | KLLGFTQLGAT-SPFSFLG--IKL--NQK--Q-YTGKKDYL | EATLIHQSITGLYETRIDLSKL- | 1352 |
| WP_049473442 | 1282 | LAS---SFI | NLLTFTAIGAP-ATFKFFD--KNI--DRK--R-YTSTTEIL | NATLIHQSITGLYETRIDLSKL- | 1342 |
| WP_049474547 | 1282 | LAS---SFI | NLLTFTAIGAP-ATFKFFD--KNI--DRK--R-YTSTTEIL | KATLIHQSITGLYETRIDLSKL- | 1342 |
| EMC03581 | 1275 | LAN---SFI | NLLTFTAIGAP-AAFKFFG--KDV--DRK--R-YTVSEIL | NATLIHQSITGLYETRIDLSKL- | 1335 |
| WP_002428612 | 1310 | LSE---SFI | NLLTFTAIGAP-AAFKFPG--KDI--DRK--R-YTVSEIL | NATLIHQSITGLYETRIDLSKL- | 1370 |
| WP_000428613 | 1303 | IAN---SFI | NLLTFTAFGAP-AVFKFFG--ERK--R-YSTVTEIL | KATLIHQSLTGLYETRIDLSKI | 1363 |
| WP_049523028 | 1275 | -AT---NML | NLFFTGLGAP-ATLKFFN--VDI--DRK--R-YTSSTEIL | NSTLIRQSITGLYETRIDLSKI | 1334 |
| WP_003107102 | 1304 | -SI---SFL | NLFKFTSFGAP-EKFTFLN--SEIkqDDV--VEI--R-YRSTKECL | NSTLIHQSVTGLYETRIDLSQF | 1365 |
| WP_049531101 | 1311 | LSE---SFI | SLLKLTSFGAP-GAFRFLG--VEI--SQSnvR-YQSVSSCF | NATLIHQSITGLYETRIDLSKI | 1373 |
| WP_049538452 | 1311 | LSE---SFI | SLLKLTSFGAP-GAFKFLG--VEI--SQSsvR-YKPNSQFL | DATLIHQSITGLYETRIDLSKL- | 1373 |
| WP_049549711 | 1313 | LSE---SFI | SLLKLTSFGAP-GAFKFLG--AEI--SQSsvR-YKPNSQFL | DTTLIHQSITGLYETRIDLSKL- | 1375 |
| WP_007896501 | 1312 | -AL---NML | NLFIFTSLGAP-STFVFFD--ETI--DRK--R-YTTSSDVL | NGILIQQSITGLYETRIDLSRF- | 1371 |
| EFR44625 | 1264 | -AL---NML | NLFIFTSLGAP-STFVFFD--ERT--DRK--R-YTTSSDVL | NGILIQQSITGLYETRIDLSRF- | 1323 |
| WP_002897477 | 1307 | LAN---SFI | NLLTFTALGAP-AAFKFFG--KDV--DRK--R-YTVSEIL | NATLIHQSITGLYETRIDLSKL- | 1367 |
| WP_002906454 | 1312 | LSE---SFI | SLLKLTSFGAP-GAFKFLG--VEI--SQSsvR-YKPNSQFL | DTTLIHQSITGLYETRIDLSKL- | 1374 |
| WP_009729476 | 1308 | LAN---SFI | NLLTFTALGAP-AAFKFPG--KDV--DRK--R-YTVSEIL | NATLIHQSITGLYETRIDLSKL- | 1368 |
| CQR24647 | 1296 | LAQ---SFI | SLLKFTAFGAP-GGFKFLG--ADI--KQSnlR-YQTVTEVL | SSTLIHQSVTGLYETRIDLSKL- | 1358 |
| WP_000666813 | 1312 | LAN---SFI | NLLTFTAIGAP-AAFKFLG--KDV--DRK--R-YTTVSEIL | NATLIHQSITGLYETRIDLSKL- | 1372 |
| WP_009754323 | 1308 | LAN---SFI | NLLTFTALGAP-AAFKFPG--KDV--DRK--R-YTTVSEIL | NATLIHQSITGLYETRIDLSKL- | 1368 |
| WP_044674937 | 1301 | LTS---SFV | NLLTFTAIGAP-AAFKFLG--SVI--DRK--R-YTSIAEIL | EATLIHQSVTGLYETRIDLSKL- | 1361 |
| WP_044676715 | 1303 | LTS---SFV | NLLTFTAIGAP-AAFKFLG--SVI--DRK--R-YTSIAEIL | EATLIHQSVTGLYETRIDLSKL- | 1363 |
| WP_044680361 | 1301 | LTS---SFV | NLLTFTAIGAP-AAFKFLG--SVI--DRK--R-YTSIAEIL | EATLIHQSVTGLYETRIDLSKL- | 1361 |
| WP_044681799 | 1314 | LTS---SFV | NLLTFTAIGAP-AAFKFLG--SVI--DRK--R-YTSIAEIL | EATLIHQSVTGLYETRIDLSKL- | 1383 |
| WP_049533112 | 1241 | ICT---SFL | GLFELTSLGSA-SDFEFIG--VKI--PRY--RdYTPSSLLK | DSTLIHQSVTGLYQSIEDYNN- | 1300 |
| WP_029090905 | 1269 | -VK---VI | ELLKITQANATnGDLKLLK---M-sNREg-R-LGSVSVAL | DFKIIHQSVTGLYQSIEDYNN-- | 1329 |
| WP_006506696 | 1306 | -AN---II | QMLIVMHRGPQnGNIVDDf--KI-sDRIg--R-LKTKNHNL | NIVFISQSPTGIYTKKYKL--- | 1365 |
| AIT42264 | 1277 | -AE---NII | HLFTLTNLGAP-AAFKFFD--TTI--DRK--R-YTSTKEVL | DATLIHQSITGLYETRIDLSQL- | 1335 |
| AKQ21048 | 1306 | LVE---NII | NLLAITKCCGPA-ADITFIG--EKI--SRK--R-YRSTNCLW | GSEVIFQSPTGLYETRLRLJE--- | 1365 |
| WP_004636532 | 1272 | -AE---NII | HLFTLTNLGAP-AAFKFYG--TTI--DRK--R-YTSTKEVL | DATLIHQSITGLYETRIDLSQL- | 1329 |
| WP_002364836 | 1278 | TVE---SFV | NLMTFTAMGAP-ATFKFFQ--ESI--TRS--R-YTSITEFR | GSTLIFQSITGLYETRYKL--- | 1335 |
| WP_016631044 | 1229 | IAA---SFI | QLMQFNAMGAP-STFKFFQ--KDI--ERA--R-YTSIKEIF | DATIYQSPTGLYETRRKV--- | 1286 |
| EMS75795 | 1014 | LSQ---SFI | NLMQLNAMGAP-ADFKFFD--VII--PRK--R-YPSLTEIW | ESTIIYQSITGLRETRTRMATLwd | 1076 |
| WP_002373311 | 1278 | IAA---SFI | QLMQFNAMGAP-STFKFFQ--KDI--ERA--R-YTSIKEIF | DATIYQSTTGLYETRRKV--- | 1335 |

```
WP_002378009   1278  IAA---SFI  QLMQFNAMGAP-STFKFFQ-KDI--ERA--R-YTSIKEIF  DATIIYQSTTGLYETRRKV------  1335
WP_002407324   1278  IAA---SFI  QLMQFNAMGAP-STFKFFQ-KDI--ERA--R-YTSIKEIF  DATIIYQSTTGLYETRRKV------  1335
WP_002413717   1278  IAA---SFI  QLMQFNAMGAP-STFKFFQ-KDI--ERA--R-YTSIKEIF  DATIIYQSTTGLYETRRKV------  1335
WP_010775580   1280  IAA---SFI  QLMQFNAMGAP-STFKFFQ-KDI--ERA--R-YTSIKEIF  DATIIYQSTTGLYETRRKV------  1337
WP_010818269   1278  IAA---SFI  QLMQFNAMGAP-STFKFFQ-KDI--ERA--R-YTSIKEIF  DATIIYQSTTGLYETRRKV------  1335
WP_010824395   1278  IAA---SFI  QLMQFNAMGAP-STFKFFQ-KDI--ERA--R-YTSIKEIF  DATIIYQSTTGLYETRRKV------  1335
WP_016622645   1278  IAA---SFI  QLMQFNAMGAP-STFKFFQ-KDI--ERA--R-YTSIKEIF  DATIIYQSTTGLYETRRKV------  1335
WP_036624816   1278  IAA---SFI  QLMQFNAMGAP-STFKFFQ-KDI--ERA--R-YTSIKEIF  DATIIYQSTTGLYETRRKV------  1335
WP_033625576   1278  IAA---SFI  QLMQFNAMGAP-STFKFFQ-KDI--ERA--R-YTSIKEIF  DATIIYQSTTGLYETRRKV------  1335
WP_033789179   1278  IAA---SFI  QLMQFNAMGAP-STFKFFQ-KDI--ERA--R-YTSIKEIF  DATIIYQSTTGLYETRRKV------  1335
WP_002310644   1280  LAS---SFV  NLMQFNAMGAP-ADFKFFD-VTI--PRK--R-YTSLTEIW  QSTIIHQSITGLYETRIRMGK----  1339
WP_002312694   1281  LAS---SFV  NLMQFNAMGAP-ADFKFFD-VTI--PRK--R-YTSLTEIW  QSTIIHQSITGLYETRIRMGK----  1340
WP_002314015   1281  LAS---SFV  NLMQFNAMGAP-ADFKFFD-VTI--PRK--R-YTSLTEIW  QSTIIHQSITGLYETRIRMGK----  1340
WP_002320716   1280  LAS---SFV  NLMQFNAMGAP-ADFKFFD-VTI--PRK--R-YTSLTEIW  QSTIIHQSITGLYETRIRMGK----  1339
WP_002330729   1281  LAS---SFV  NLMQFNAMGAP-ADFKFFD-VTI--PRK--R-YTSLTEIW  QSTIIHQSITGLYETRIRMGK----  1340
WP_002335161   1281  LAS---SFV  NLMQFNAMGAP-ADFKFFD-VTI--PRK--R-YTSLTEIW  QSTIIHQSITGLYETRIRMGK----  1340
WP_002345439   1281  LAS---SFV  NLMQFNAMGAP-ADFKFFD-VTI--PRK--R-YTSLTEIW  QSTIIHQSITGLYETRIRMGK----  1340
WP_034867970   1271  IAQ---SFL  QLLQFNAIGAP-ADFKFFG-VTI--PRK--R-YTSLTEIW  DATIIYQSVTGLYETRIRMGDLwa   1333
WP_047937432   1281  LAS---SFL  NLMQFNAMGAP-ADFKFFD-VTI--PRK--R-YTSLTEIW  QSTIIHQSITGLYETRIRMGK----  1340
WP_010720994   1271  IAQ---SFL  QLLQFNAIGAP-ADFKFPG-VTI--PRK--R-YTSLTEIW  DATIIYQSVTGLYETRIRMGDLwa   1333
WP_010737004   1271  IAQ---SFL  QLLQFNAIGAP-ADFKFFG-VTI--PRK--R-YTSLTEIW  DATIIYQSVTGLYETRIRMGDLwa   1333
WP_034700478   1271  IAQ---SFL  QLLQFNAIGAP-ADFKFFG-VTI--PRK--R-YTSLTEIW  DATIIYQSVTGLYETRIRMGDLwa   1333
WP_007209003   1270  IAK---SFI  NLLTFTAMGAP-ADFEFFG-EKI--PRK--R-YVSISEII  DAVPIHQSITGLYETRVRLTEV---  1330
WP_023519017   1265  MID---AIL  SLLKFTLFGAS-VEFKFFD-IKI--LK---YKSLTDIW   EATIIYQSITGLYERRVEVRKLwd   1326
WP_010777040   1275  IAE---SFV  NLMKFSAYGAP-MDFKFFG-KTI--PRS--R-YTSVGBLL  SATINQSITGLYETRRKL-------  1332
WP_048604708   1271  IAQ---SFV  DLMQLNAFGAP-ADFKFFG-ETI--PRK--R-YTSVNELL  EATINQSITGLYETRRRL-------  1328
WP_010750235   1274  MAH---SFV  NLMQFNALGAP-ADFKFFD-TTI--TRK--R-YTSLTEIW  QSTIIYQSVTGLYETRRRMADLwd   1336
AII16058       1345  -AE---NII  HLFTLTNLGAP-AAFKYFD-TTI--DRK--R-YTSTKEVL  DATLIHQSITGLYETRIDLSQL---  1404
WP_029073316   1283  -CE---VI   QMIvVMHAGPQnGNITFDdf--KL-sNRLg-R-LNCKTISL  TTVFIADSPTGMYSKKYKL------  1343
WP_031589969   1284  -CN---II   QILATLHCNSsIGKIMYSDf-KI-sTTIg-R-LNGRTISL  DISFIAESPTGMYSKKYKL------  1344
KDA45870       1254  LGK---NFV  ELLRYTADGAA-SDFKFFG-ENI--PRK--R-YNSAGSLL  NGTLIYQSKTGLYETRIDLGKL---  1314
WP_039099354   1307  ILDr---V   -LIGLHANAAV-SDLGVLKisTPL-GKM--Q--QPSGIS   DTQIIYQSPTGLFERRVALRDL---  1368
AKP02966       1297  INS1-eELI  TLLHANSTSAH-LIFNNIE-kKAF-GRK------THGLT   DTDFIYQSVTGLYTRIHIE------  1356
WP_010991369   1275  IAQ---SFV  DLMAFNAMGAP-ASFKFFE-TTI--ERK--R-YNNLKELL  NSTIIYQSITGLYESRKRL------  1332
WP_033838504   1275  IAQ---SFV  DLMAFNAMGAP-ASFKFFE-TTI--ERK--R-YNNLKELL  NSTIIYQSITGLYESRKRL------  1332
EHN60060       1278  IAQ---SFV  DLMAFNAMGAP-ASFKFFE-TTI--ERK--R-YNNLKELL  NSTIIYQSITGLYESRKRL------  1335
EFR89594       1044  IAQ---SFV  DLMAFNAMGAP-RDFEFFE-TTI--KRK--R-YYNIKELL  NATIIYQSITGLYEARKRL------  1101
WP_038409211   1275  IAK---SFD  KLKVFNAFGAP-RDFKFFE-TTI--KRK--R-YTNLKELL  KLKVFNAFGAP-RDFKFFE-TTI---  1332
EFR95520       894   IAK---SFD  KLKVFNAFGAP-RDFKFFE-TTI--KRK--R-YTNLKELL  NATIIYQSITGLYEARKRL------  951
WP_003723650   1275  IAQ---SFV  DLMAFNAMGAP-ASFKFFE-ATI--DRK--R-YTNLKELL  SSTIIYQSITGLYESRKRL------  1332
WP_003727705   1275  IAQ---SFV  DLMAFNAMGAP-ASFKFFE-ATI--DRK--R-YTNLKELL  SSTIIYQSITGLYESRKRL------  1332
WP_003730785   1275  IAE---SFV  DLMAFNAMGAP-ASFKFFE-ATI--DRK--R-YTNLKELL  SSTIIYQSITGLYESRKRL------  1332
WP_003733029   1275  IAQ---SFV  SLKKFNAFGVH-QDFSFFG-TKI--ERK--R-YTNLKELL  NSTIIYQSITGLYESRKRL------  1332
WP_003739838   1275  IAQ---SFV  NLMAFNAMGAP-ASFKFFE-ATI--DRK--R-YTNLKELL  SATIIYQSITGLYESRKRL------  1332
WP_014601172   1275  IAQ---SFV  DLMAFNAMGAP-ASFKFFE-ATI--DRK--R-YTNLKELL  SSTIIYQSITGLYEARKRL------  1332
WP_023548323   1275  IAE---SFV  SLKKFNAFGVH-KDFNFFG-TTI--KRK--R-YTNLKELL  NSTIIYQSITGLYESRKRL------  1332
WP_031665337   1275  IAE---SFV  SLKKFNAFGVH-QDFSFFG-TKI--ERK--R-YDRKLKELL NSTIIYQSITGLYESRKRL------  1332
WP_031669209   1275  IAE---SFV  SLKKFNAFGVH-KDFNFFG-TTI--KRK--R-YTNLKELL  NSTIIYQSITGLYESRKRL------  1332
WP_033920898   1275  IAQ---SFV  DLMAFNAMGAP-ASFKFFE-ATI--DRK--R-YTNLKELL  SSTIIYQSITGLYESRKRL------  1332
AKI42028       1278  IAE---SFV  DLMVFNAMGAP-ASFKFFE-TNI--ERK--R-YNNLKELL  SSTIIYQSITGLYEARKRL------  1335
AKI50529       1278  IAQ---SFV  DLMAFNAMGAP-ASFKFFE-TTI--KRK--R-YTNLKELL  NSTIIYQSITGLYEARKRL------  1335
EFR83390       723   IAQ---SFV  DLMAFNAMGAP-ASFKFFE-TNI--ERK--R-YNNLKELL  NATIIYQSITGLYEARKRL------  780
WP_046323366   1275  -AE---NII  HLFTLTNLGAP-AAFKYFD-TTI--DRK--R-YTSTKEVL  DATLIHQSITGLYETRIDLSQL---  1332
AKE81011       1322                                                                             1381
```

```
                                                   -continued
CUO82355      1273  -AN----VI  QMLIIMHKGPQnGNIIYDdf--NV-gKRIg-R-LNGRTFYL  NIEFISQSPTGIYTKKYKL-----  1333
WP_033162887  1275  -CD----VI  QILIIMHAGPMnGNIMYDdf--KF-tNRIg-R-FTHKNIDL  KTFISTSVTGLFSKKYKL------  1335
AGZ01981      1339  -AE---NII  HLFTLTNLGAP-AAFKYFD--TTI--DRK--R-YTSTKEVL  DATLIHQSITGLYETRIDLSQL-  1398
AKA60242      1306  -AE---NII  HLFTLTNLGAP-AAFKYFD--TTI--DRK--R-YTSTKEVL  DATLIHQSITGLYETRIDLSQL-  1365
AKS40380      1306  -AE---NII  HLFTLTNLGAP-AAFKYFD--TTI--DRK--R-YTSTKEVL  DATLIHQSITGLYETRIDLSQL-  1365
4UN5_B        1310  -AE---NII  HLFTLTNLGAP-AAFKYFD--TTI--DRK--R-YTSTKEVL  DATLIHQSITGLYETRIDLSQL-  1369

WP_010922251  1366  GGD  1368
WP_039695303  1370  GEE  1372
WP_045635197  1368  GED  1370
5AXW_A        ---
WP_009880683  1050  GGD  1052
WP_010922251  1366  GGD  1368
WP_011054416  1366  GGD  1368
WP_011284745  1366  GGD  1368
WP_011285506  1366  GGD  1368
WP_011527619  1366  GGD  1368
WP_012560673  1366  GGD  1368
WP_014407541  1365  GGD  1367
WP_020905136  1365  GGD  1367
WP_023080005  1366  GGD  1368
WP_023610282  1365  GGD  1367
WP_030125963  1366  GGD  1368
WP_030126706  1366  GGD  1368
WP_031488318  1366  GGD  1368
WP_032460140  1366  GGD  1368
WP_032461047  1366  GGD  1368
WP_032462016  1366  GGD  1368
WP_032462936  1366  GGD  1368
WP_032464890  1366  GGD  1368
WP_033888930  1191  GGD  1193
WP_038431314  1365  GGD  1367
WP_038432938  1366  GGD  1368
WP_038434062  1277  GGD  1279
BAQ51233      541   GGD  543
KGE60162      304   GGD  306
KGE60856      1366  GGD  1368
WP_002989955  1343  GEE  1345
WP_003030002  1371  GEE  1373
WP_003065552  1368  GED  1370
WP_001040076  1376  GED  1378
WP_001040078  1368  GED  1370
WP_001040080  1368  GED  1370
WP_001040081  1368  GED  1370
WP_001040083  1368  GED  1370
WP_001040085  1368  GED  1370
WP_001040087  1368  GED  1370
WP_001040088  1368  GED  1370
WP_001040089  1368  GED  1370
WP_001040090  1368  GED  1370
WP_001040091  1368  GED  1370
WP_001040092  1368  GED  1370
WP_001040094  1368  GED  1370
```

| | | |
|---|---|---|
| WP_001040095 | GEG | 1370 |
| WP_001040096 | GEG | 1370 |
| WP_001040097 | GED | 1370 |
| WP_001040098 | GED | 1370 |
| WP_001040099 | GED | 1370 |
| WP_001040100 | GED | 1370 |
| WP_001040104 | GED | 1370 |
| WP_001040105 | GED | 1370 |
| WP_001040106 | GED | 1370 |
| WP_001040107 | GED | 1370 |
| WP_001040108 | GED | 1370 |
| WP_001040109 | GED | 1370 |
| WP_001040110 | GED | 1370 |
| WP_015058523 | GED | 1370 |
| WP_017643650 | GED | 1370 |
| WP_017647151 | GED | 1370 |
| WP_017648376 | GED | 1384 |
| WP_017649527 | GED | 1370 |
| WP_017771611 | GED | 1370 |
| WP_017771984 | GED | 1370 |
| CFQ25032 | GED | 1370 |
| CFV16040 | GED | 1370 |
| KLJ37842 | GGD | 1370 |
| KLJ72361 | GED | 1370 |
| KLL20707 | GED | 1382 |
| KLL42645 | GED | 1368 |
| WP_047207273 | GED | 1370 |
| WP_047209694 | GED | 1370 |
| WP_050198062 | GED | 1370 |
| WP_050201642 | GED | 1370 |
| WP_050204027 | GED | 1370 |
| WP_050881965 | GED | 1370 |
| WP_050886065 | GED | 1370 |
| AHN30376 | GED | 1370 |
| EAO78426 | GED | 1386 |
| CCW42055 | GED | 1346 |
| WP_003041502 | GED | 1346 |
| WP_037593752 | GED | 1345 |
| WP_049516684 | GEE | 1377 |
| GAD46167 | GGD | 1375 |
| WP_183634470 | GED | 1345 |
| WP_003043819 | GGD | 1365 |
| WP_006269658 | GGD | 1371 |
| WP_048800889 | GGD | 1371 |
| WP_012767106 | GGD | 1371 |
| WP_014612333 | GGD | 1371 |
| WP_015017095 | GGD | 1348 |
| WP_015057649 | GEN | 1348 |
| WP_049519324 | GEN | 1348 |
| WP_012515931 | GEN | 1348 |
| WP_021320964 | GEN | 1348 |
| WP_037581760 | GEE | 1377 |
| WP_004232481 | GEE | 1377 |

| | | | |
|---|---|---|---|
| WP_009854540 | 1368 | GEE | 1370 |
| WP_012962174 | 1369 | GEE | 1371 |
| WP_039695303 | 1370 | GEE | 1372 |
| WP_014334983 | 1373 | GEE | 1375 |
| WP_003099269 | 1366 | GGK | 1368 |
| AHY15608 | | --- | |
| AHY17476 | | --- | |
| ESR09100 | 198 | GGK | 200 |
| AGM98575 | | --- | |
| ALF27331 | 1343 | GEN | 1345 |
| WP_018372492 | 1351 | GED | 1353 |
| WP_045618028 | 1374 | GED | 1376 |
| WP_045635197 | 1368 | GED | 1370 |
| WP_002263549 | 1343 | GGD | 1345 |
| WP_002263887 | 1343 | GGD | 1345 |
| WP_002264920 | 1343 | GGD | 1345 |
| WP_002269043 | 1343 | GGD | 1345 |
| WP_002269448 | 1343 | GGD | 1345 |
| WP_002271977 | 1343 | GGD | 1345 |
| WP_002272766 | 1343 | GGD | 1345 |
| WP_002273241 | 1343 | GGD | 1345 |
| WP_002275430 | 1343 | GGD | 1345 |
| WP_002276448 | 1343 | GGD | 1345 |
| WP_002277050 | 1353 | GGD | 1355 |
| WP_002277364 | 1343 | GGD | 1345 |
| WP_002279025 | 1343 | GGD | 1345 |
| WP_002279859 | 1343 | GGD | 1345 |
| WP_002280230 | 1343 | GGD | 1345 |
| WP_002281696 | 1343 | GGD | 1345 |
| WP_002282247 | 1353 | GGD | 1355 |
| WP_002282906 | 1343 | GGD | 1345 |
| WP_002283846 | 1343 | GGD | 1345 |
| WP_002287255 | 1343 | GGD | 1345 |
| WP_002288990 | 1343 | GGD | 1345 |
| WP_002289641 | 1343 | GGD | 1345 |
| WP_002290427 | 1343 | GGD | 1345 |
| WP_002295753 | 1343 | GGD | 1345 |
| WP_002296423 | 1343 | GGD | 1345 |
| WP_002304487 | 1357 | GGD | 1359 |
| WP_002305844 | 1343 | GGD | 1345 |
| WP_002307203 | 1343 | GGD | 1345 |
| WP_002310390 | 1343 | GGD | 1345 |
| WP_002352408 | 1343 | GGD | 1345 |
| WP_012997688 | 1343 | GGD | 1345 |
| WP_014677909 | 1343 | GGD | 1345 |
| WP_019312892 | 1343 | GGD | 1345 |
| WP_019313659 | 1343 | GGD | 1345 |
| WP_019314093 | 1343 | GGD | 1345 |
| WP_019315370 | 1343 | GGD | 1345 |
| WP_019803776 | 1343 | GGD | 1345 |
| WP_019805234 | 1343 | GGD | 1345 |
| WP_024783594 | 1353 | GGD | 1355 |
| WP_024784288 | 1343 | GGD | 1345 |
| WP_024784666 | 1343 | GGD | 1345 |

-continued

| | | |
|---|---|---|
| WP_024784894 | 1343 | GGD | 1345 |
| WP_024786433 | 1353 | GGD | 1355 |
| WP_049473442 | 1343 | GGD | 1345 |
| WP_049474547 | 1343 | GGD | 1345 |
| EMC03581 | 1336 | GGD | 1338 |
| WP_000428612 | 1371 | GED | 1373 |
| WP_000428613 | 1369 | GED | 1371 |
| WP_049523028 | 1364 | GEE | 1366 |
| WP_003107102 | 1335 | GGD | 1337 |
| WP_054279288 | 1366 | GED | 1368 |
| WP_049531101 | 1374 | GED | 1376 |
| WP_049538452 | 1374 | GED | 1376 |
| WP_049549711 | 1376 | GED | 1378 |
| WP_007896501 | 1372 | GGD | 1374 |
| EFR44625 | 1324 | GGD | 1326 |
| WP_002897477 | 1368 | GEE | 1370 |
| WP_002906454 | 1375 | GED | 1377 |
| WP_009729476 | 1369 | GED | 1371 |
| CQR24647 | 1359 | GGE | 1361 |
| WP_000066813 | 1373 | GED | 1375 |
| WP_009754323 | 1369 | GED | 1371 |
| WP_044674937 | 1362 | GGD | 1364 |
| WP_044676715 | 1364 | GGD | 1366 |
| WP_044680361 | 1364 | GGD | 1366 |
| WP_044681799 | 1362 | GGD | 1364 |
| WP_049533112 | 1384 | GED | 1386 |
| WP_029090905 | | ---- | |
| WP_006506696 | | ---- | |
| AIT42264 | 1366 | GGD | 1389 |
| WP_034440723 | | ---- | |
| AKQ21048 | 1366 | GGD | 1384 |
| WP_004636532 | 1330 | -ED | 1332 |
| WP_002364836 | 1336 | -VD | 1337 |
| WP_016631044 | 1287 | -VD | 1288 |
| EMS75795 | 1077 | GEQ | 1079 |
| WP_002373311 | 1336 | -VD | 1337 |
| WP_002378009 | 1336 | -VD | 1337 |
| WP_002407324 | 1336 | -VD | 1337 |
| WP_002413717 | 1338 | -VD | 1339 |
| WP_010775580 | 1336 | -VD | 1337 |
| WP_010818269 | 1336 | -VD | 1337 |
| WP_010824395 | 1336 | -VD | 1337 |
| WP_016622645 | 1336 | -VD | 1337 |
| WP_033624816 | 1336 | -VD | 1337 |
| WP_033625576 | 1336 | -VD | 1337 |
| WP_033789179 | 1336 | ---- | |
| WP_002310644 | | ---- | |
| WP_002312694 | | ---- | |
| WP_002314015 | | ---- | |
| WP_002320716 | | ---- | |
| WP_002330729 | | ---- | |
| WP_002335161 | | ---- | |
| WP_002345439 | | ---- | |
| WP_034867970 | 1334 | GEQ | 1336 |

-continued

| | | | |
|---|---|---|---|
| WP_047937432 | 1334 | --- | 1336 |
| WP_010720994 | 1334 | GEQ | 1336 |
| WP_010737004 | 1334 | GEQ | 1336 |
| WP_034700478 | | GEQ | |
| WP_007209003 | 1327 | GER | 1330 |
| WP_023519017 | 1333 | -VD | 1334 |
| WP_010770040 | 1329 | -GD | 1330 |
| WP_048604708 | 1337 | GVQ | 1339 |
| WP_010750235 | 1405 | GGD | 1424 |
| AII16583 | | --- | |
| WP_029073316 | | --- | |
| WP_031589969 | | --- | |
| KDA45870 | | --- | |
| WP_039099354 | | --- | |
| AKP02966 | 1333 | -DD | 1334 |
| WP_010991369 | 1333 | -DD | 1334 |
| WP_033838504 | 1336 | -DD | 1337 |
| EHN60060 | 1102 | -DD | 1103 |
| EFR89594 | 1333 | -DD | 1334 |
| WP_038409211 | 952 | -ED | 953 |
| EFR95520 | 1333 | -ED | 1334 |
| WP_003723650 | 1333 | -DD | 1334 |
| WP_003727705 | 1333 | -DD | 1334 |
| WP_003730785 | 1333 | -DN | 1334 |
| WP_003733029 | 1333 | -DG | 1334 |
| WP_003739838 | 1333 | -DD | 1334 |
| WP_014601172 | 1333 | -DS | 1334 |
| WP_023548323 | 1333 | -DD | 1334 |
| WP_031665337 | 1333 | -DN | 1334 |
| WP_031669209 | 1333 | -DS | 1334 |
| WP_033920898 | 1336 | -DD | 1337 |
| AKI42028 | 1336 | -DS | 1337 |
| AKI50529 | 781 | -DD | 782 |
| EFR83390 | 1333 | -DD | 1334 |
| WP_046323366 | 1382 | GGD | 1400 |
| AKE81011 | | --- | |
| CUO82355 | | --- | |
| WP_033162887 | 1399 | GGD | 1417 |
| AGZ01981 | 1366 | GGD | 1368 |
| AKA60242 | 1366 | GGD | 1376 |
| AKS40380 | 1370 | GGD | 1372 |
| 4UN5_B | | | |

EQUIVALENTS AND SCOPE, INCORPORATION BY REFERENCE

Those skilled in the art will recognize, or be able to ascertain using no more than routine experimentation, many equivalents to the specific embodiments of the invention described herein. The scope of the present invention is not intended to be limited to the above description, but rather is as set forth in the appended claims.

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention also includes embodiments in which more than one, or all of the group members are present in, employed in, or otherwise relevant to a given product or process.

Furthermore, it is to be understood that the invention encompasses all variations, combinations, and permutations in which one or more limitations, elements, clauses, descriptive terms, etc., from one or more of the claims or from relevant portions of the description is introduced into another claim. For example, any claim that is dependent on another claim can be modified to include one or more limitations found in any other claim that is dependent on the same base claim. Furthermore, where the claims recite a composition, it is to be understood that methods of using the composition for any of the purposes disclosed herein are included, and methods of making the composition according to any of the methods of making disclosed herein or other methods known in the art are included, unless otherwise indicated or unless it would be evident to one of ordinary skill in the art that a contradiction or inconsistency would arise.

Where elements are presented as lists, e.g., in Markush group format, it is to be understood that each subgroup of the elements is also disclosed, and any element(s) can be removed from the group. It is also noted that the term "comprising" is intended to be open and permits the inclusion of additional elements or steps. It should be understood that, in general, where the invention, or aspects of the invention, is/are referred to as comprising particular elements, features, steps, etc., certain embodiments of the invention or aspects of the invention consist, or consist essentially of, such elements, features, steps, etc. For purposes of simplicity those embodiments have not been specifically set forth in haec verba herein. Thus for each embodiment of the invention that comprises one or more elements, features, steps, etc., the invention also provides embodiments that consist or consist essentially of those elements, features, steps, etc.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in different embodiments of the invention, to the tenth of the unit of the lower limit of the range, unless the context clearly dictates otherwise. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

In addition, it is to be understood that any particular embodiment of the present invention may be explicitly excluded from any one or more of the claims. Where ranges are given, any value within the range may explicitly be excluded from any one or more of the claims. Any embodiment, element, feature, application, or aspect of the compositions and/or methods of the invention, can be excluded from any one or more claims. For purposes of brevity, all of the embodiments in which one or more elements, features, purposes, or aspects is excluded are not set forth explicitly herein.

All publications, patents and sequence database entries mentioned herein, including those items listed above, are hereby incorporated by reference in their entirety as if each individual publication or patent was specifically and individually indicated to be incorporated by reference. In case of conflict, the present application, including any definitions herein, will control.

SEQUENCE LISTING (5530 sequences)

SEQ ID NO: 1 - protein, 167 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 2 - protein, 8 aa, Artificial Sequence
  Synthetic Polypeptide
SGGSSGGS

SEQ ID NO: 3 - protein, 84 aa, Artificial Sequence
  Synthetic Polypeptide
MTNLSDIIEKETGKQLVIQESILMLPEEVEEVIGNKPESDILVHTAYDESTDENVMLLTSDAPEYKPWALVIQDSNGENKIKML

SEQ ID NO: 4 - protein, 7 aa, Artificial Sequence
  Synthetic Polypeptide
PKKKRKV

SEQ ID NO: 5 - protein, 30 aa, Artificial Sequence
  Synthetic Polypeptide
MDSLLMNRRKFLYQFKNVRWAKGRRETYLC

SEQ ID NO: 6 - DNA, 23 bp, Artificial Sequence
  Synthetic Polynucleotide
gaacacaaagcatagactgcggg

SEQ ID NO: 7 - DNA, 23 bp, Artificial Sequence
  Synthetic Polynucleotide
gaacacaaagcatagactgctgg

SEQ ID NO: 8 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 9 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 10 - protein, 16 aa, Artificial Sequence
  Synthetic Polypeptide
SGSETPGTSESATPES

SEQ ID NO: 11 - protein, 1561 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 12 - protein, 1561 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 13 - protein, 1561 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 14 - protein, 1561 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 15 - protein, 1648 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 16 - protein, 1648 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 17 - protein, 1648 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 18 - protein, 1648 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 19 - protein, 1648 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 20 - protein, 1648 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 21 - protein, 1784 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSPKKKRKV

SEQ ID NO: 22 - protein, 1784 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSPKKKRKV

SEQ ID NO: 23 - protein, 1784 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSPKKKRKV

SEQ ID NO: 24 - protein, 1787 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPSGGSPKKKRKV

SEQ ID NO: 25 - protein, 1787 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPSGGSPKKKRKV

SEQ ID NO: 26 - protein, 1787 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPSGGSPKKKRKV

SEQ ID NO: 27 - protein, 1550 aa, Artificial Sequence
  Synthetic Polypeptide
MSEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 28 - protein, 1550 aa, Artificial Sequence
  Synthetic Polypeptide
  misc_feature (155)..(155): Xaa can be any naturally occurring amino acid
MSEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQXIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 29 - protein, 181 aa, Erwinia tasmaniensis
MASRGVNKVILVGNLGQDPEVRYMPNGGAVANITLATSESWRDKQTGETKEKTEWHRVVLFGKLAEVAGEYLRKGSQVYIEGALQTRKWTDQAGVEKYTTEVVVNVGGTMQMLGGRSQGGGASAGGQNGGSNNGWGQPQQPQGGNQFSGGAQQQARPQQQPQQNNAPANNEPPIDFDDDIP

SEQ ID NO: 30 - protein, 209 aa, Artificial Sequence
  Synthetic Polypeptide
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRRIHKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 31 - protein, 313 aa, Artificial Sequence
  Synthetic Polypeptide
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQEPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 32 - protein, 219 aa, Artificial Sequence
  Synthetic Polypeptide
KGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 33 - protein, 222 aa, Artificial Sequence
  Synthetic Polypeptide
DLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQP

SEQ ID NO: 34 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 35 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1367 aa, Artificial Sequence
  Synthetic Polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 37 - protein, 4 aa, Artificial Sequence
  Synthetic Polypeptide
SGGS

SEQ ID NO: 38 - protein, 4 aa, Artificial Sequence
  Synthetic Polypeptide
GGGS

SEQ ID NO: 39 - protein, 5 aa, Artificial Sequence
  Synthetic Polypeptide
GGGGS

SEQ ID NO: 40 - protein, 5 aa, Artificial Sequence
  Synthetic Polypeptide
EAAAK

SEQ ID NO: 41 - DNA, 23 bp, Artificial Sequence
  Synthetic Polynucleotide
cccgcagtctatgctttgtgttc

SEQ ID NO: 42 - DNA, 23 bp, Artificial Sequence
  Synthetic Polynucleotide
ggcccagactgagcacgtgatgg

SEQ ID NO: 43 - DNA, 23 bp, Artificial Sequence
  Synthetic Polynucleotide
ggcactgcggctggaggtggggg

SEQ ID NO: 44 - DNA, 23 bp, Artificial Sequence
  Synthetic Polynucleotide
gtcatcttagtcaggacctgagg

SEQ ID NO: 45 - DNA, 23 bp, Artificial Sequence
  Synthetic Polynucleotide
ggaatcccttctgcagcacctgg

SEQ ID NO: 46 - DNA, 23 bp, Artificial Sequence
  Synthetic Polynucleotide
gagtccgagcagaagaagaaggg

SEQ ID NO: 47 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 48 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 49 - DNA, 4212 bp, Artificial Sequence
  Synthetic Polynucleotide
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 50 - protein, 1368 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 51 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 52 - protein, 1368 aa, Streptococcus pyogenes [sequence omitted]

SEQ ID NO: 53 - protein, 1368 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 54 - protein, 1368 aa, Artificial Sequence; identical to SEQ ID NO: 53
  Synthetic Polypeptide

SEQ ID NO: 55 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 56 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 57 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 58 - protein, 1367 aa, Artificial Sequence; identical to SEQ ID NO: 36
  Synthetic Polypeptide

SEQ ID NO: 59 - protein, 1367 aa, Artificial Sequence; identical to SEQ ID NO: 35
  Synthetic Polypeptide

SEQ ID NO: 60 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 61 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 62 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 63 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 64 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 65 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTD

SEQ ID NO: 66 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTD

SEQ ID NO: 67 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTD

SEQ ID NO: 68 - protein, 166 aa, Artificial Sequence
  Synthetic Polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQEIKAQKKAQSSTD

SEQ ID NO: 69 - protein, 166 aa, Artificial Sequence
  Synthetic Polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQDIKAQKKAQSSTD

SEQ ID NO: 70 - protein, 166 aa, Artificial Sequence
  Synthetic Polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQGIKAQKKAQSSTD

SEQ ID NO: 71 - protein, 166 aa, Artificial Sequence
  Synthetic Polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQVIKAQKKAQSSTD

SEQ ID NO: 72 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGVRNAKTGAAGSLMDVLHHPGMNHRVEITEGILADECAALLSYFFRMRRQVIKAQKKAQSSTD

SEQ ID NO: 73 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 74 - protein, 166 aa, Artificial Sequence
  Synthetic Polypeptide
AEVEFSHEYWMRHALTLAKRAWDEREVPVGAVLVHNNRVIGEGWNRPFGRHDPTAHAEIMALRQGGLVMQNYRLIDATLYVTLEPCVMCAGAMIHSRIGRVVFGVRNAKTGAAGSLMDVLHHPGMNHRVEITEGILADECAALLSYFFRMRRQVIKAQKKAQSSTD

SEQ ID NO: 75 - protein, 166 aa, Artificial Sequence
  Synthetic Polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGTRNAKTGAAGSLMDVLHHPGMSHRVEITEGILADECAALLSDFFRMRRQEIKAQSKAQSSTD

SEQ ID NO: 76 - protein, 166 aa, Artificial Sequence
  Synthetic Polypeptide
SEVEFSHEYWMRHALTLAKRAWDEGEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNDLLSYFFRMRRQVFKAQKKAQSSTD

SEQ ID NO: 77 - protein, 166 aa, Artificial Sequence
  Synthetic Polypeptide
SEVEFSHEYWMRHALTLAKRAWDGGEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNDLLSYFFRMRRQVFKAQKKAQSSTD

SEQ ID NO: 78 - protein, 166 aa, Artificial Sequence
  Synthetic Polypeptide
SEVEFSHEYWMRHALTLAKRAWDDGEVPVGAVLVHNNRVIGEGWNRPIGRHDPTAHAEIMALRQGGLVMQNYRLIDATLYVTFEPCVMCAGAMIHSRIGRVVFGVKNAKTGAAGSLMDVLHYPGMNHRVEITEGILADECNGLLSYFFRMRRQVFKAQKKAQSSTD

SEQ ID NO: 79 - protein, 166 aa, Artificial Sequence
  Synthetic Polypeptide
SEVEFSHEYWMRHALTLAKRAWDEQEVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNALLSYFFRMRRQVFKAQKKAQSSTD

SEQ ID NO: 80 - protein, 166 aa, Artificial Sequence
  Synthetic Polypeptide
SEVEFSHEYWMRHALTLAKRAWDMGEVPVGAVLVHNNRVIGEGWNRPIGRHDPTAHAEIMALRQGGLVMQNYRLIDATLYVTFEPCVMCAGAMIHSRIGRVVFGVPNAKTGAAGSLMDVLHYPGMNHRVEITEGILADECNDLLSYFFRMRRQVFKAQKKAQSSTD

SEQ ID NO: 81 - protein, 166 aa, Artificial Sequence
  Synthetic Polypeptide
SEVEFSHEYWMRHALTLAKRAWDECEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNALLSYFFRMRRQVFKAQKKAQSSTD

SEQ ID NO: 82 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNLLLSYFFRMRRQVFKAQKKAQSSTD

SEQ ID NO: 83 - protein, 166 aa, Artificial Sequence
  Synthetic Polypeptide
SEVEFSHEYWMRHALTLAKRAWDEGEVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNALLSYFFRMRRQVFKAQKKAQSSTD

SEQ ID NO: 84 - protein, 178 aa, E. coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 85 - DNA, 23 bp, Artificial Sequence
  Synthetic Polynucleotide
tatatgcatatttattacatcgg

SEQ ID NO: 86 - DNA, 23 bp, Artificial Sequence
  Synthetic Polynucleotide
ccgtcatgtgggtcctgaattgg

SEQ ID NO: 87 - DNA, 23 bp, Artificial Sequence
  Synthetic Polynucleotide
acactgaaagactccaggtcagg

SEQ ID NO: 88 - DNA, 23 bp, Artificial Sequence
  Synthetic Polynucleotide
gtcagaagagatgtggtcaatgg

SEQ ID NO: 89 - DNA, 23 bp, Artificial Sequence
  Synthetic Polynucleotide
tttaaagtgaagcagcatctggg

SEQ ID NO: 90 - DNA, 23 bp, Artificial Sequence
  Synthetic Polynucleotide
atttaaagtgaagcagcatctgg

SEQ ID NO: 91 - DNA, 23 bp, Artificial Sequence
  Synthetic Polynucleotide
actccatgacagtgtaattttgg

SEQ ID NO: 92 - DNA, 23 bp, Artificial Sequence
  Synthetic Polynucleotide
gcctggagaagccatccagcagg

SEQ ID NO: 93 - DNA, 23 bp, Artificial Sequence
  Synthetic Polynucleotide
ctcagacacactcattgatgagg

SEQ ID NO: 94 - DNA, 24 bp, Artificial Sequence
  Synthetic Polynucleotide
gaggcactgcccccaccatgagcg

SEQ ID NO: 95 - DNA, 85 bp, Artificial Sequence
  Synthetic Polynucleotide
tcataagcattctgccgacatggaagccgtcgcatacggtgtggtgcacctggatggccagcggcatcagcaccttgtcgccttg

SEQ ID NO: 96 - protein, 29 aa, Artificial Sequence
  Synthetic Polypeptide
ENLMRGVHFGDCVTHHVQIALPMLVKDGQ

SEQ ID NO: 97 - DNA, 86 bp, Artificial Sequence
  Synthetic Polynucleotide
tcattaagcattctgccgacatggaagccgtcgcatacggcgcggtgcacctggatggccagcggcatcagcaccttgtcgccttg

SEQ ID NO: 98 - protein, 29 aa, Artificial Sequence
  Synthetic Polypeptide
ENLMRGVHFGDCVARHVQIALPMLVKDGQ

SEQ ID NO: 99 - DNA, 59 bp, Artificial Sequence
  Synthetic Polynucleotide
ccgtcgcatacggtgtggtgcacctggatggccagcggcatcagcaccttgtcgccttg

SEQ ID NO: 100 - DNA, 96 bp, Artificial Sequence
  Synthetic Polynucleotide
caaatattatacgcaaggcgacaaggtgctgatgccgctggccatccaggtgcaccacgccgtatgcgacggcttccatgtcggcagaatgcttaa

SEQ ID NO: 101 - protein, 32 aa, Artificial Sequence
  Synthetic Polypeptide
KYYTQGDKVLMPLAIQVHHAVCDGFHVGRMLN

SEQ ID NO: 102 - DNA, 96 bp, Artificial Sequence
  Synthetic Polynucleotide
caaatattatacgcaaggcgacaaggtgctgatgccgctggccatccaggtgcactacgccgtatgcgacggcttccatgtcggcagaatgcttaa

SEQ ID NO: 103 - protein, 32 aa, Artificial Sequence
  Synthetic Polypeptide
KYYTQGDKVLMPLAIQVHYAVCDGFHVGRMLN

SEQ ID NO: 104 - DNA, 86 bp, Artificial Sequence
  Synthetic Polynucleotide
caaatattatacgcaaggcgacaaggtgctgatgccgctggccatccaggtgcaccacgccgtatgcgacggctccagtcgccaaa

SEQ ID NO: 105 - protein, 84 aa, Artificial Sequence
  Synthetic Polynucleotide
  misc_feature (1)..(3): Xaa can be any naturally occurring amino acid
  misc_feature (6)..(8): Xaa can be any naturally occurring amino acid
  misc_feature (23)..(26): Xaa can be any naturally occurring amino acid
  misc_feature (30)..(30): Xaa can be any naturally occurring amino acid
  misc_feature (34)..(34): Xaa can be any naturally occurring amino acid
  misc_feature (37)..(37): Xaa can be any naturally occurring amino acid
  misc_feature (39)..(39): Xaa can be any naturally occurring amino acid
  misc_feature (41)..(41): Xaa can be any naturally occurring amino acid
  misc_feature (43)..(44): Xaa can be any naturally occurring amino acid
  misc_feature (50)..(50): Xaa can be any naturally occurring amino acid
  misc_feature (52)..(56): Xaa can be any naturally occurring amino acid
  misc_feature (60)..(64): Xaa can be any naturally occurring amino acid
  misc_feature (66)..(66): Xaa can be any naturally occurring amino acid
  misc_feature (68)..(70): Xaa can be any naturally occurring amino acid
  misc_feature (72)..(73): Xaa can be any naturally occurring amino acid
  misc_feature (76)..(77): Xaa can be any naturally occurring amino acid
  misc_feature (80)..(82): Xaa can be any naturally occurring amino acid
  misc_feature (84)..(84): Xaa can be any naturally occurring amino acid
XXXRLXXXTLYVTLEPCVMCAGXXXXSRIXRVVXGAXDXKXGXXGSLMBXLXXXXXNHRXXXXXGXLXXXCXXLLXXFFXXXRX

SEQ ID NO: 106 - protein, 84 aa, Artificial Sequence
  Synthetic Polypeptide
QNYRLIDATLYVTLEPCVMCAGAMIHSRIGRVVFGARDAKTGAAGSLMDVLHHPGMNHRVEITEGILADECAALLSDFFRMRRQ

SEQ ID NO: 107 - protein, 84 aa, Artificial Sequence
  Synthetic Polypeptide
GSWRLEGCTLYVTLEPCVMCAGTIVMSRIPRVVYGADDPKGGCSGSLMNLLQQSNFNHRAIVDKGVLKEACSTLLTTFFKNLRA

SEQ ID NO: 108 - protein, 1359 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 109 - protein, 1355 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFANEIAKVDESFFQRLDESFLTDDDKTFDSHPIFGNKAEEDAYHQKFPTIYHLRKHLADSSEKADLRLVYLALAHMIKFRGHFLIEGELNAENTDVQKIFADFVGVYNRTFDDSHLSEITVDVASILTEKISKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNILSKIKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDISSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKLGEE

SEQ ID NO: 110 - protein, 1359 aa, Streptococcus mitis
KKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLTEEKEYHKQFPTIYHLRKQLADSKEKTDLRLIYLALAHMIKYRGHFLYEEAFDIKNNDIQKIFNEFISIYDNTFEGSSLSGQNAQVEAIFTDKISKSAKRERVLKLFPDEKSTGLFSEFLKLIVGNQADFKKHFDLEDKAPLQFSKDTYDEDLENLLGQIGDDFTDLFVSAKKLYDAILLSGILTVTDPSTKAPLSASMIERYENHQNDLAALKQFIKNNLPEKYDEVFSDQSKDGYAGYIDGKTTQETFYKYIKNLLSKFEGTDYFLDKIEREDFLRKQRTFDNGSIPHQIHLQEMNAILRRQGEYYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVNQLFKENRKVTEKDIIHYLHNVDGYDGIELKGIEKQFNASLSTYHDLLKIIKDKEFMDDAKNEAILENIVHTLTIFEDREMIKQRLAQYDSLFDEKVIKALTRRHYTGWGKLSAKLINGICDKQTGNTILDYLIDDGKINRNFMQLINDDGLSFKEIIQKAQVIGKTDDVKQVVQELSGSPAIKKGILQSIKIVDELVKVMGHAPESIVIEMARENQTTARGKKNSQQRYKRIEDSLKILASNILKENPTDNNQLQNDRLFLYYLQNGKDMYTGEALDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILLDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETWIDLSKLGED

SEQ ID NO: 111 - protein, 986 aa, Staphylococcus Aureus
MKRNYILGLDIGITSVGYGIIDYETRDVIDAGVRLFKEANVENNEGRRSKRGARRLKRRRRHRIQRVKKLLFDYNLLTDHSELSGNPYEARVKGLSQKLSEEEFSAALLHLAKRRGVHNVNEVEEDTGNELSTKEQISRNSKLEEKYVAELQLERLKKDGEVRGSINRKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKENAELLDQIAKILTIYQSSEDIQEELTNLNSELTQEEIEQISNLKGYTGTHNLSLKAINLILDELWTNDNQIAIFNRLKLVPKKVDLSQQKEIPTTLVDDFILSPVVKRSFIQSIKVINAIIKKYGLPNDIIIELAREKNSKDAQKMINEMQKQTNEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDQKDFINRNLVDTRYATRGLMNLLRSYFRVNNLDVKVKSINGGFTSFLRRKWKFKKERNKGYKHHAEDALIIANADFIFKEWKKLDKNQMFEEKETEQEYKEIFITPHQIKHIKDFKDYKYSHRVDKKPNREVNNLNGLYDKDNDKLKKLINKSPEKLLMYHHDPQTYQKKLIMEQYGDEKNLYKYYEETGNYLTKYSKKDNGPVIKKIKYYGNKLNAHLDITDDYPNSVKLSLKPYRFDVYLDNGVYKFVTVKNLDVIKKENYYEVNSKAYEEAKKKKISNQAEFIASFYNNDLIKINGELYRVIGVNNDLLNRIEVNMIDITYREYLENMNDKRPPRIIKTIASKTQSIKKLYEVKSKKHPQIIKKG

SEQ ID NO: 112 - protein, 1044 aa, Streptococcus pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 113 - protein, 1359 aa, Streptococcus pyogenes; identical to SEQ ID NO: 108

SEQ ID NO: 114 - protein, 1359 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 115 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 116 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 117 - protein, 1359 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 118 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 119 - protein, 1358 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 120 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 121 - protein, 1358 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 122 - protein, 1358 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYEIRIDLSQLGGD

SEQ ID NO: 123 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKASLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 124 - protein, 1359 aa, Streptococcus pyogenes
MDKKYSIGLDIGTNSVGWAVITDDYKVPSKKFKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 125 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNFGAPAAFIYFDTTIGRNRYKSIKEVLDATLIHQSITGLYETRIDLSQLGGD

SEQ ID NO: 126 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 127 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGGLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 128 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINANGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 129 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKKNGLFGNLIALLLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKKYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 130 - protein, 1359 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNRKDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 131 - protein, 1184 aa, Streptococcus pyogenes
PDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 132 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 133 - protein, 1358 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 134 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKIVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 135 - protein, 1270 aa, Streptococcus pyogenes
MAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 136 - protein, 536 aa, Streptococcus pyogenes
QELDINRLSGYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 137 - protein, 305 aa, Streptococcus pyogenes
IETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 138 - protein, 1359 aa, Artificial Sequence
  Synthetic Polypeptide
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 139 - protein, 1341 aa, Artificial Sequence
  Synthetic Polypeptide
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 140 - protein, 1356 aa, Artificial Sequence
  Synthetic Polypeptide
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDISSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 141 - protein, 1365 aa, Streptococcus agalactiae
MNKPYSIGLDIGTNSVGWSIITDDYKVPAKKIRVLGNTDKEYIKKNLIGALLFDGGNTAADRRLKRTARRRYTRRRNRILYLQEIFAEEMSKVDDSFFHRLEDSFLVEEDKRGSKYPIFATLQEEKYYHEKFPTIYHLRKELADKKEKADLRLVYLALAHIIKFRGHFLIEDDRFDVRNTDIQKQYQAFLEIFDTTFENNDLLSQDVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIVADSSKDGYAGYIEGKTNQEAFYKYLSKLLTKQEGSEYFLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVIGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFVFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDIFQIINDFSKRVILADANLEKINRLYQDNKENIPVDELANNIINLFTFTSLGAPAAFKFFDKIVDRKRYTSTKEVLNSTLIHQSITGLYETRIDLGKLGED

SEQ ID NO: 142 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKQEKADLRLIYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGLYRRKKLSKIVRATRKMFFYSNLMNMFKRVVRLADGSIVVRPVIETGRYMGKTAWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSKFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLSKLGED

SEQ ID NO: 143 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNITFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 144 - protein, 1369 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTIFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGETIDRLQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 145 - protein, 1363 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIIQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 146 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDDLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 147 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 148 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 149 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 150 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVVGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 151 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLRQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 152 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 153 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQHYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 154 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWERLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 155 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 156 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 157 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 158 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPKVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 159 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPLLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLDIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 160 - protein, 1365 aa, Streptococcus agalactiae
  misc_feature (117)..(117): Xaa can be any naturally occurring amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 161 - protein, 1365 aa, Streptococcus agalactiae
MNKPYSIGLDIGTNSVGWSIITDDYKVPAKKMRVLGNTDKEYIKKNLIGALLFDGGNTAADRRLKRTSRRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 162 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTCRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 163 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 164 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGETLDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEREFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 165 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQFITGLYETRIDLGKLGED

SEQ ID NO: 166 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 167 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 168 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSEKKPKYVKDQVENHHLSDDRLFLYYLQNGKDMYTDDELDIDNLSQYDIDLIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 169 - protein, 1365 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDIEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 170 - protein, 1365 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 171 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 172 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTALSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 173 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVAADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 174 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKASLSDSMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 175 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVEIRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 176 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTVKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 177 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDELFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 178 - protein, 1365 aa, Streptococcus agalactiae; identical to SEQ ID NO: 147

SEQ ID NO: 179 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNKGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 180 - protein, 1365 aa, Streptococcus agalactiae
MNKPYSIGLDIGTNSVGWSIITDDYKVPAKKMRVLGNTDKEYIKKNLIGALLFDGRNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 181 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDSFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 182 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVIKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 183 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVASILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 184 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIESKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 185 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNLSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIIDRKRYTSTKEVLNSTLIHQSITGLYETRIDLGKLGED

SEQ ID NO: 186 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKDIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 187 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKIILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDSLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 188 - protein, 1365 aa, Streptococcus agalactiae
  misc_feature (9)..(9): Xaa can be any naturally occurring amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 189 - protein, 1365 aa, Streptococcus agalactiae
MNKPYSIGLDIGTNSVGWSIITDDYKVPAKKMRVLGNTDKEYIKKNLIGALLFDGGNTAADRRLKRIARRRYTRRRNRILYLQEIFAEKMSKVDDSFFHRLEDSFLVEEDKRGSKYPIFATLQEEKDYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPDQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEELVDKEASAEAFIHCMTNNDLYLPEEKVLPKHSLIYEKFTVYNELTKVRYKNEQGETYFFDSNIKQEIFDGVFKEYRKVSKKQLLDFLAKEFEEFRIVDVTGLDKENKAFNASLGTYHDLEKILGKDFLDNPDNESILEDIVQTLTLFEDREMIKKRLDIYKDFFTESQLKKLYRRHYTGWGRLSAKLINGIRNKENQKTILDYLIDDGSANRNFMQLIKDAGLSFKSIISKAQSGSHSDNLKEVVSELAGSPAIKKGILQSLKIVDELVKVMGYKPEQIVVEMARENQTTNQGRRNSRQRYKLLDDGVRNLASNILKEYPTDNQALQNERLFLYYLQNGRDMYTEKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 190 - protein, 1351 aa, Streptococcus anginosus
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVSDKEIGKATAKYFFYSNLMNFFKKEVKFADGTVVERPDIETSEDGEIAWNKQTDFKIVRKVLSYPQVNIVKKTEVQTHGLDRPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASRGEIHKGNELFVPQKFTTLLYHAKRINNPINKDHIEYVKKHRDDFKELLNYVLEFNEKYVGATKNGERLKEAVADFDSKSNEEICTSFLGLFELTSLGSASDFEFLGVKIPRYRDYTPSSLLKDSTLIHQSITGLYETRIDLSKLGED

SEQ ID NO: 191 - protein, 1341 aa, Streptococcus anginosus
MKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 192 - protein, 1341 aa, Streptococcus anginosus
MKKEYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVEEDKRGSRYPIFGNIAAEVKYHDDFPTIYHLRKHLVDISQKADLRLVYLALAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYEEHQKDLKKLKDFIKVNAPAQYDDIFKDETKNGYAGYIENGVKQDEFYKYLKNTLSKIDGSDYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 193 - protein, 1341 aa, Streptococcus anginosus; identical to SEQ ID NO: 191

SEQ ID NO: 194 - protein, 1360 aa, Streptococcus caballi
MTKKNYSIGLDIGTNSVGWAVITDDYKVPAKKMKVLGNTDKKYIKKNLLGALLFDSGETAEATRLKRTARRRYTRRKNRLRYLQDIFTEEMAKVDDSFFQRLDESFLTDNDKNFDSHPIFGNKAEEDAYHQKFPTIYHLRKHLADSTEKADLRLVYLALAHMIKFRGHFLIEGELNAENTDVQKLFTDFVGVYDRTFDDSHLSEITVDAASILTEKISKSRRLENLINNYPKEKKNTLFGNLIALALGLQPNFKTNFKLSEDAKLQFSKDTYEEDLEELLGKIGDDYADLFTSSKNLYDAILLSGILTVDDNSTKAPLSASMIKRYVEHHEDLEKLKEFIKANKSELYHDIFKDKTQNGYAGYIENGVKQDEFYKYLKGILTKINGSDYFLDKIEREDFLRKQRTFDNGSIPHQIHLQEMHAILRRQGDYYPFLKENQEEIEKILTFRIPYYVGPLARKDSRFAWAEYRSDEKITPWNFDKVIDKEKSAEKFITRMTLNDLYLPEEKVLPKHSHVYETFAVYNELTKVKYVNEQGKDSFFDSNMKQEIFDHVFKENRKVTKEKLLNYLDKEFPEYRIQDLVGLDKENKSFNASLGTYHDLKKILDKSFLDDKVNEEVIEDIIKTLTLFEDREMIQQRLQKYSDIFTKQQLKKLERRHYTGWGRLSYKLINGIRNKENNKTILDYLIDDGSANRNFMQLINDDALSFKQIIQEAQVVGDVDDIETVVHDLPGSPAIKKGILQSVKIVDELIKVMGDNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLGIVRARKAEWVRLYKSGLISKRKFDNLTKAERGGLTEADKAGFIKRQLVETRQITKHVAQILDARFNTERDENDKVIRDVKVITLKSNLVSQFRKEFKFYKVREINDYHHAHDAYLNAVVGTALLKKYPKLAPEFVYGEYKKYDVSSDDHSEMGKATAKYFFYSNLMNFFKRVIRYSNGKVIVRPVVEYSKDTGEIAWNKRTDFEKVRKVLSYPQVNIVKKVETQTGGFSKESILPKGDSDKLIPRKTKKVLWEPKKYGGFDSPTVAYSVLVVADVEKGKTKKLKTVKELVGISIMERSFFEKNPVEFLKNKGYQNVQEDKLMKLPKYSLFEFEGGRRRLLASATELQKGNEIMLSAHLVALLYHAHRIGNFNSAEHLKYVSEHKKEFEEVLSCVENFANVYVDVEKNLSKIRAAADSMDNFSIEEISDSFINLLTLTALGAPADFNFLGEKIPRKRYNSTKECLNATLIHQSITGLYETRIDLSKLGEE

SEQ ID NO: 195 - protein, 1355 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 196 - protein, 1341 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 197 - protein, 1355 aa, Streptococcus constellatus
MTQKYSIGLDIGTNSVGWAIVTDDYKVPAKKMKILGNTNKQYIKKNLLGALLFDSGETAKATRLKRTARRRYTRRKNRLRYLQEIFIEEMNKVDENFFQRLDDSFLVTEDKRGSKYPIFGTLKEEKEYYKEFETIYHLRKRLADSTGKVDLRLVYLALAHMIKFRGHFLIEGQLKAENTDVQTLFNDFVEVYDKTIEESHLAEITVDALSILTEKVSKSRRLENLVKCYPTEKKNTLFGNLIALSLGLQPNFKTNFQLSEDAKLQFSKDTYEEDLEELLGKIGDDYADLFTSAKNLYDTILLSGILAVDDNSTKALLSASMIKRYEEHQKDLKKLKDFIKVNAPAQYDDIFKDETKNGYAGYIENGVKQDEFYKYLKNTLSKIDGSGYFLDKIEREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYEIFTVYNELTKVKYVNEQGEAKFFDANMKQEIFDHVFKENPKVTKDKLLNYLDKEFDEFRIVDLTGLDKENKAFNASLGTYHDLRKILDKSFLDDKANEKTIEDIIQTLTLFEDREMIRQRLQKYSDIFTKAQLKKLERRHYTGWGRLSYKLINGIRNKENNKTILEYLVDDGYANRNFMQLINDDTLPFKQIIKDAQAIDDVDDIELIVHDLPGSPAIKKGILQSIKIVDELVKVMGYNPDNIVIEMARENQTTTKGRRNSQQRLKLLQDSLTPVSIKNVENQQLQNDRLFLYYIQNGKDMYTGEELDIHHLSDYDIDHIIPQAFIKDDSIDNRVLTSSAKNRGKSDNVPNLEVVCDRKADWIRLREAGLISQRKFDNLTKAERGGLTENDKAGFIHRQLVETRQITKHVAQILDARFNPKRDDNKKVIRDVKIITLKSNLVSQFRRDFKLYKVREINDYHHAHDAYLNAVVGTALLKKYPKLTSEFVYGEYKKYDVSDNDEIGKATAKYFFYSNLMNFFKTEVKFADGTVVERPDIETSEDGEIAWNKQTDFKIVRKVLSYPQVNIVKKVEKQTGRFSKESILPKGDSDKLIARKTKENYWDTKKYGGFDSPTVAYSVLVVADIKKGKAKKLKTVKELVGISIMERPFFEKNPIMFLESKGYRNIQKDKLIKLPKYSLFEFEGGRRRLLASAVELQKGNEMVLPQYLNNLLYHAHRIDNSDNSEHLKYITEHKEEFGKLLSYIENFAKSYVDVDKNLEKIQLAVEKIDSFSVKEISNSFIHLLTLTALGAPADFNFLGEKIPRKRYTSTKECLNATLIHQSITGLYETQTDLSKLGED

SEQ ID NO: 198 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 199 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 200 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 201 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 202 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKCKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 203 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 204 - protein, 1345 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASSELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 205 - protein, 1345 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLASSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASSELQKGNELFLPVDYMTFLYLAAHYHELTGSSEDVLRKKYFVERHLHYFDDIIQMINDFAERHILASSNLEKINHTYHNNSDLPINERAENIINVFTFVALGAPAAFKFFDATIDRKRYTSTKEVLNATLIHQSVTGLYETRIDLSQLGEN

SEQ ID NO: 206 - protein, 1345 aa, Streptococcus equi
MKKPYTIALDIGTNSVGWVVVTDDYRVPTKKMKVLGNTERKTIKKNLIGALLFDSGDTAEGTRLKRTARPRYTRRKNRLRFLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQLQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASSELQKGNELFLPVDYMTFLYLAAHYHELTGSSEDVLRKKYFVERHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 207 - protein, 1360 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 208 - protein, 1353 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDISSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 209 - protein, 1354 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDISGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 210 - protein, 1355 aa, Streptococcus gallolyticus; identical to SEQ ID NO: 109

SEQ ID NO: 211 - protein, 1358 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 212 - protein, 1358 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 213 - protein, 1263 aa, Streptococcus iniae
  misc_feature (1257)..(1257): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFXEVKSSF

SEQ ID NO: 214 - protein, 1257 aa, Streptococcus iniae
  misc_feature (1255)..(1255): Xaa can be any naturally occurring amino acid
  misc_feature (1257)..(1257): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYXFX

SEQ ID NO: 215 - protein, 199 aa, Streptococcus iniae
MEQDEFEKDPIAFLEKKGYQDIQTSSIIKLPKYSLFELENGRKRLLASKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 216 - protein, 1271 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFDVRLSQVFRVTNVEF

SEQ ID NO: 217 - protein, 1345 aa, Streptococcus intermedius
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIEDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYIGPLARGKSDFSWLSRKSADKITPWNFDEIVDKESSAEAFINRMTNYDLYLPNQKVLPRHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKNLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIANIEKGKSKKLKLVKDLVGITIMERTIFEKNPVAFLERKGYRNVQEENIVKLPKYSLFELENGRRRLLASARELQKGNEIVLPNHLGTMLYHAKNIHKVDEPKHLDYVKKHKDEFKELLDVVSNFSKKNILAESNLEKIEELYAQNNNKDITELASSFINLLTFTAIGAPAAFKFFDNNIDRKRYTSTTEILNATLIHQSITGLYETRIDLSRLGGD

SEQ ID NO: 218 - protein, 1333 aa, Streptococcus massiliensis
MKKPYSIGLDIGTNSVGWAVVMEDYKVPSKKMKVLGNTDKQSIKKNLIGALLFDSGETAVERRLNRTTSRRYDRRRNRIRYLQHIFAEEMNRADENFFHRLKESFFVEEDKTYSKYPIFGTLEEEKNYHKNYPTIYHLRKTLADTPDKMDIRLIYLALAHIIKYRGHFLIEGDLDIENIGIQDSFKSFIEEYNTQFGTKLDSTTKVEAIFTENSSKAKRVETILGLFPDETAAGNLDKFLKLMLGNQADFKKVFDLEEKITLQFSKDSYEEDLELLLSKIDEEYAALFDLAKKVYDAVLLSNILTVKEKNTKAPLSASMIKRYEEHKDDLKAFKRFFRERLPEKYETMFKDLTKPSYAAYVSGAVTEDDFYKFSKGLLIDVEGAEYFLEKIEREDFLRKQRTFDNGAIPNQVHVKELQAIILNQSKYYPFLAENKEKIEKILTFRIPYYVGPLARGNSSFAWLQRKSDEAIRPWNFEQVVDMETSASRFIERMTLHDLYLPDEKVLPRHSLIYEKYTVFNELTKVRFTPEGGKEVYFSKTDKENIFDSLFKRYRKVTKRKLKDFIEKELGYGYIDIDNIKGVEEQFNASYTTYQDLLKIIGDKEFLDNEENKDLLEEIIYILTVFEDRKMIEKRLSELNIPFENKIIKKLARKKYTGWGNLSRKLIDGIRNRETNRTILGHLIDDGFSNRNLMQLINDDGLDFKEIIRKAQTIENIDTNQALVSSLPGSPAIKKGILQSLNIVDEIIAIMGYAPTNIVIEMARENQTTQKGRDNSAQRLKKIEDGIKLGSDLLKQNPIQDNKDLQKEKLFLYYMQNGIDLYTGQPLNCDPDSLAFYDVDHIVPRSYIKNDSFDNKVLTTSKGNRKKLDDVPAKEVVEKMENTWRRLHAAGLISDIKLSYLMKGELTEEDKAGFIRRQLVETRQITKHVARLLDEKLNRKKNENGEKLRTTKIITLKSVFASRFRANFDLYKLRELNHYHHAHDAYLNAVVAQALLKVYPKFERELVYGSYVKESIFSRKATERMRMYNNILKFISKDKKDQETGEIVWDKKEIENIVKKVIYSSPVNIVKKREEQSGALFKQSNMAVGYNNKLIPRKKDWSVDKYGGFIEPAESYSLAIFYTDINGKKPKKKSTIIAISRMEKKDYEKEPERFLAQKGFERVEKTIKLPKYSLFEMEKGRRRLLASSGELQKGNQVLLPEHLIRLLSYAKKVDVLVKSKDDDYDLEEHRAEFAELLDCIKKFNDMYILASSNMSKIEEIYQKNIDAPIEEVARSFVLLNFTMMGAATDFKFFGQIIPRKRYPSTTECLKSTLIHQSVTGLYETRIDLSKLGEN

SEQ ID NO: 219 - protein, 1361 aa, Streptococcus mitis
NNKPYSIGLDIGTNSVGWAVITDDYKVPSKKMKVLGNTDKHFIKKNLLGALLFDEGTTAEDRRLKRTARRRYTRRKNRLRYLQEIFTEEMSKVDISFFHRLDDSFLVPEDKRGSKYPIFATLEEEKEYHKNFPTIYHLRKHLADSKEKADFRLIYLALAHIIKYRGHFLYEESFDIKNNDIQKIFNEFISIYDNTFEGSSLNGQNAQVEAIFTDKISKSAKRERVLKLFPDEKSTGLFSEFLKLIVGNQADFKKHFDLEEKAPLQFSKDTYDEDLENLLVQIGDDFADLFLVAKKLYDAILLSGILTVTDPSTKAPLSASMIDRYENHQKDLAALKQFIKTNLPEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKARSAEDFINKMTNYDLYLPEEKVLPKHSLLYETFAVYNELTKVKFIAEGLRDYQFLDSGQKQQIVTQLFKEKRKVTEKDIIQYLHNVDSYDGIELKGIEKQFNASLSTYHDLLKIIKDKEFMDDSKNEAILENIVHTLTIFEDREMIKQRLAHYASIFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKVMGHAPESIVIEMARENQTTARGKKNSQQRYKRIEDALKNLAHNILKEHPTDNIQLQNDRLFLYYLQNGKDMYTGKSLDINQLSSCDIDHIIPQAFIKDDSLDNRVLTSSKDNRGKSDNVPSLEIVQKRKAFWQQLLDSKLISERKFNNLTKAERGGLDERDKVGFIKRQLVETRQITKHVAQILDARFNTEVTEKDKKDRSVKIITLKSNLVSNFRKEFRLYKVREINDYHHAHDPYLNAVVAKAILKKYPKLEPEFVYGDYQKYDLTKDPKEVEKATEKYFFYSNLLNFFKEEVHYADGTIVKRENIEYSKDTGEIAWNKEKDFATIKKVLSLPQVNIVKKTEEQTGGLFDNNIVSKKKVVDASKLTPIKSGLSPEKYGGYARPTIAYSVLVIADIEKGKAKKLKRIKEMVGITVQDKKKFEANPIAYLEECGYKNINPNLIIKLPKYSLFEFNNGQRRLLASSIELQKGNELIVPYHFTALLYHAQRINKISEPIHKQYVETHQSEFKELLTAIISLSKKYIQKPNVESLLQQAFDQSDKDIYQLSESFISLLKLISFGAPGTFKFLGVEISQSNVRYQSVSSCFNATLIHQSITGLYETRIDLSKLGED

SEQ ID NO: 220 - protein, 1359 aa, Streptococcus mitis; identical to SEQ ID NO: 110

SEQ ID NO: 221 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 222 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 223 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 224 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 225 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 226 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 227 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 228 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 229 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 230 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 231 - protein, 1336 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLEATLIHQSITGLYETRIDLNKLGGD

SEQ ID NO: 232 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 233 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 234 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 235 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 236 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 237 - protein, 1336 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLEATLIHQSITGLYETRIDLSKLGGD

SEQ ID NO: 238 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 239 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 240 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 241 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 242 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 243 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 244 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 245 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 246 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 247 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 248 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 249 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKHQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 250 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGQRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPDHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 251 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 252 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 253 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 254 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIIGNQADFKKHFELEEKAPLQFSKDTYEEELEVLLAQIGDNYAELFLSAKKLYDSILLSGILTVTDVGTQAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 255 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 256 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGECHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGNGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 257 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKVPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 258 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQNLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 259 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKSKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 260 - protein, 1336 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYLKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLEATLIHQSITGLYETRIDLSKLGGD

SEQ ID NO: 261 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLVQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 262 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 263 - protein, 1336 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMNKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLEATLIHQSITGLYETRIDLSKLGGD

SEQ ID NO: 264 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYYENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 265 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILKATLIHQSITGLYETRIDLSKLGGD

SEQ ID NO: 266 - protein, 1338 aa, Streptococcus mutans
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 267 - protein, 1362 aa, Streptococcus oralis
ENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 268 - protein, 1360 aa, Streptococcus oralis
ENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 269 - protein, 1358 aa, Streptococcus parasanguinis
KKPYSIGLDIGTNSVGWAVITDDYKVPAKKMKVLGNTNKESIKKNLIGALLFDAGNTAADRRLKRTARRRYTRRRNRILYLQEIFAAEMNKVDESFFHRLDDSFLVPEDKRGSKYPIFGTLEEEKEYHKQFPTIYYLRKILADSKEKVDLRLIYLALAHIIKYRGHFLYEDSFDIKNNDIQKIFNEFTILYDNTFEESSLSKGNAQVEEIFTDKISKSAKRDRVLKLFPDEKSTGLFSEFLKLIVGNQADFKKHFDLEEKAPLQFSKDTYEEDLESLLGQIGDVYADLFVVAKKLYDAILLAGILSVKDPGTKAPLSASMIERYDNHQNDLSALKQFVRRNLPEKYAEVFSDDSKDGYAGYIDGKTTQEGFYKYIKNLISKIEGAEYFLEKIEREDFLRKQRTFDNGSIPHQIHLQEMNAILRHQGEYYPFLKENKDKIEQILTFRIPYYVGPLARGNSDFAWLSRNSDEAIRPWNFEEMVDKSSSAEDFIHRMTNYDLYLPEEKVLPKHSLLYETFTVYNELTKVKYIAEGMKDYQFLDSGQKKQIVNQLFKEKRKVTEKDIIHYLHNVDGYDGIELKGIEKHFNSSLSTYHDLLKIIKDKEFMDDPKNEEIFENIVHTLTIFEDRVMIKQRLNQYDSIFDEKVIKALTRRHYTGWGKLSAKLINGIRDKKTSKTILDYLIDDGYSNRNFMQLINDDGLSFKETIQKAQVVGETNDVKQVVQELPGSPAIKKGILQSIKIVDELVKVMGHAPESVVIEMARENQTTNKGKSKSQQRLKTLSDAISELGNILKEHPTDNIQLQNDRLFLYYLQNGKDMYTGEALDINQLSNYDIDHIIPQAFIKDDSLDNRVLTSSKDNRGKSDNVPSLEIVEKMKGFWQQLLDSKLISERKFNNLTKAERGGLDERDKVGFIKRQLVETRQITKHVAQILDDRFNAEVNEKNQKLRSVKIITLKSNLVSNFRKEFGLYKVREINDYHHAHDAYLNAVVAKAILKKYPKLEPEFVYGDYQKYDLTKDPKEIEKATEKYFFYSNLLNFFKDKVYYADGTIIQRGNVEYSKDTGEIAWNKKRDFAIVRKVLSYPQVNIVKKTEEQTGGFSKESILPKGNSDKLIPRKTKNVQLDTTKYGGFDSPVIAYSILLVADVEKGKSKKLKTVKSLIGITIMEKVKFEANPVAFLEGKGYQNVVEENIIRLPKYSLFELENGRRRMLASAKELQKGNEMVLPSYLIALLYHAKRIQKKDEPEHLEYIKQHHSEFNDLLNFVSEFSQKYVLAESNLEKIKNLYIDNEQTNMEEIANSFINLLTFTAFGAPAVFKFFGKDIERKRYSTVTEILKATLIHQSLTGLYETRIDLSKLGEE

SEQ ID NO: 270 - protein, 1327 aa, Streptococcus parauberis
MKVLGNTDRQTVKKNMIGTLLFDSGETAEARRLKRTARRRYTRRINRIKYLQSIFDDEMSKIDSAFFQRIKDSFLVPDDKNDDRHPIFGNIKDEVDYHKNYPTIYHLRKKLADSDEKADLRLIYLALAHIIKFRGHFLIEGDLDSQNTDVNALFLKLVDTYNLMFEDDIDTQTIDATVILTEKMSKSRRLENLIAKIPNQKKNTLFGNLISLSLGLTPNFKANFELSEDAKLQISKESFEEDLDNLLAQIGDQYADLFIAAKNLSDAILLSDILTVKGVNTKAPLSASMVQRFNEHQDDLKLLKKLVKVQLPEKYKEIFDIKDKNGYAGYINGKTSQEDFYKYIKPILSKLKGAESLISKLEREDFLRKQRTFDNGSIPHQIHLNELKSIIRRQEKYYPFLKDKQVRIEKIFTFRIPYFVGPLANGNSSFAWVKRRSNESITPWNFEEVVEQEASAKVFIERMTNFDTYLPEEKVLPKHSLLYEMFTVYNELTKVKYQAEGMRKPEFLSSEEKIEIVSNLFKTERKVTVKQLKENYFNKIRCLDSITISGVEDKFNASLGTYHDLLNIIKNQKILDDEQNQDSLEDIVLTLTLFEDEKMIAKRLSKYESIFDPSILKKLKKRHYTGWGRLSQKLINGIRDKQTGKTILDFLIDGQANRNFMQLINDPSLDFASIIKEAQEKTIKSEKLEETIANLAGSPAIKKGILQSVKIVDEVVKVMGYEPSNIVIEMARENQSTQRGINNSRERLRKLEEVHKNIGSKILKEHEISNAQLQSDRVYLYLLQDGKDMYTGKDLDFDRLSQYDIDHIIPQSFIKDNSIDNIVLTSQESNRGKSDNVPYIAIVNKMKSYWQHQLKSGAISQRKFDNLTKAERGGLSEYDKAGFIKRQLVETRQITKHVAQILNNRFNNNVDDSSKNKRPVKIITLKSKMVSDFRKEFGFYKIREVNDYHHAHDAYLNAVVGTALLKKYPKLEAEFVYGDYKHYDLSDTSLGKATAKMFFYSNIMNFFKKEVRLADGTVITRPQIETNTETGEIVWDKVKDIKTIRKVLSIPQINVVKKTEVQTGGFSKESILSKRDSDKLIPRKNNWDPKKYGGFGSPIIAYSVLVVAKVTKGKSQKTKSVKELVGITIMEQNEFEKDRITFLEKKGYQDIQESLIIKLPKFSLFELENGRKRLLASELQKGNELSLPNKYIQFLYLASRYTSFSGKEEDREKHRHFVESHLHYFDEIKDIIADFSRRYILADANLEKILTLYNEKNQFSIEEQATNMLNLFTFTGLGAPATLKFFNVDIDRKRYTSSTEILNSTLIRQSITGLYETRIDLSKIGGD

SEQ ID NO: 271 - protein, 1355 aa, Streptococcus phocae
KKSYSIGLDIGTNSVGWAVITDDYKVPAKKMKVLGNTSRQSIKKNMIGALLFDEGGPAASTRVKRTTRRRYTRRKNRLCYLRDIFESEMHTIDKHFFLRLEDSFLHKSDKRYEAHPIFGTLQEEKAYHDNYPTIYHLRKALADNTEKADLRLIYLALAHIIKFRGHFLIEGALSANNTDVQQLVHALVDAYNIMFEEDLDIEAIDVKAILTEKISKTRRLENLISNIPGQKKNGLFGNLIALSLGLTPNFKSHFNLPEDAKLQLAKDTYDEELNNLLTQIGDEYADLFLSAKNLSDAILLSDILTVNGDGTQAPLSASLIKRYEEHRQDLALLKQMFKEQLPDLYRDVFTDENKDGYAGYISGKTSQEAFYKYIKPILETLDGAEDFLTKINREDFLRKQRTFDNGSIPHQIHLGELQAILERQQAYYPFLKDNQEKIEKILTFRIPYYIGPLARGNSRFAWLTRTSDQKITPWNFDEMVDQEASAQAFIERMTNFDEYLPQEKVLPKHSLTYEYFTVYNELTKVKYVTEGMTKPEFLSAGQKEQIVELLFKKYRKVTVKQLKEDFFSKIECFDTVDISGVEDKFNASLGTYHDLLKIIKDKAFLDNSENENIIEDIILTLTLFEDKEMIANRLAVYEDLFDQNVLKQLKRRHYTGWGRLSKQLINGMRDKHTGKTILDFLKDGFINRNFMQLINDDNLSFKEEIKKAQEGGLKDSINDQIRDLAGSPAIKKGILQTINIVDEIVKIMGKAPQHIVVEMARDVQKTDIGVKQSRERMKRVQEVLKKLGSQLLKEHPVENFQLQNERLYLYYLQNGKDMYTGEELSISNLSHYDIDHIIPRSFIKDDSIDNKVLTRSEHNRGKTDNVPSIEVVKRMKPYWQKLLDTKVISQRKFDNLTKAERGGLQESDKANFIQRQLVETRQITKHVAQILDSRFNTERDEKDRPIRRVKVITLKSKFVSDFRQDFGFYKLREINDYHHAHDAYLNAVVGTALLKMYPKLASEFVYGDYQKYDLSGKASGHATAKYFFYSNLMNFFKSEVKLANGNIIKRSPIEVNEETGEIVWDKTKDFGTVRKVLSAPQVNIVKKTEIQTGGFSNETILSKGKSSKLIPRKNKWRDTTKYGGFNTPTVAYSVLVVAKVEKGKAKKLKPVKELVGITIMERTKFEANPIAFLESKGYHDIQEHLMITLPKYSLFELENGRRRLLASELQKGNEMVLPQHLVTFLYRVSKRDKGTQSENMEYISNHKEKFIEIFHYIIRYAEKNVIKPKVIERLNDTFNQKFNDSDLTELSISFLNLFKFTSFGAPEKFTFLNSEIKQDDVRYRSTKECLNSTLIHQSVTGLYETRIDLSQFGGD

SEQ ID NO: 272 - protein, 1361 aa, Streptococcus pseudopneumoniae
SNKPYSIGLDIGTNSVGWAVITDDYKVPSKKMKVLGNTDKHFIKKNLIGALLFDEGTTAEDRRLKRTARRRYTRRKNRLRYLQEIFSEEISKVDNSFFHRLDDSFLVPEDKRGSKYPIFATLTEEKEYYKQFPTIYHLRKQLADSKEKADLRLIYLTLAHMIKYRGHFLYEESFDIKNNDIQKIFNEFISIYDNTFEGSSLSGQNAQVEAIFTDKISKSTKRERVLKLFPDQKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLPEKYDEVFSDQSKEGYAGYIDSKTTQEAFYKYIKNLLSKIDGADYLLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEAFINKMTNYDLYLPEEKVLPKHSLLYETFAVYNELTKVKFIAEGLRDYQFLDSGQKKKIINQLFKEKRKVTEKDLIHYLHNVDGYDGIELKGIEKQFNASLSTYHDLLKIIKDKRFMDEPKNQEILENIVHTLTIFEDREMIKQRLAQYASIFDEKVIKTLTRRHYTGWGKLSAKLINCIRDRKTGKTILDYLIDDGYNNRNFMQLINDDGLSFKEIIQESQVVGKPDDVKQIVQELPGSSAIKKGILQSIKLVDELVKVMGHDPESIVIEMARENQTTARGKKNSQQRYKRIEDSLKILASNILKEHPTDNIQLQNDRLFLYYLQNGKDMYTGNPLDINHLSSYDIDHIIPQAFIKDDSLDNRVLTSSKDNRGKSDNVPSLEVVQKRKAFWQQLLESKLISERKFNNLTKAERGGLNERDKVGFIKRQLVETRQITKHVAQILDSRFNTKVNEKNQKIRTVKIITLKSNLVSNFRKEFRLYKVREINDYHHAHDAYLNAVVAKAILKKYPKLEPEFVYGDYQKYDLSRDPKEIEKATEKYFFYSNLLNFFKEEVHYADGTIVKRENIEYSKDTGEIAWNKEIDFATIRKILSLSQVNIVKKTEEQTGGLFDNNIVSKKKVVDASKLIPIKSGLSPEKYGGYARPTIAYSVLVIADIEKGKAKKLKRIKEMVGITIQDKKKFEANPTAYLEEYGYKNINPNLIIKLPKYSLFKFNDGQRRLLASSIELQKGNELILPYHFTTLLYHAQRINKISEPIHKQYVETHQSEFEELLTTIISLSKKYIQKPIVESLLQQAFEQADKDIYQLSESFISLLKLTSFGAPGAFRFLGVEISQSNVRYQSVSSCFNATLIHQSITGLYETRIDLSKLGED

SEQ ID NO: 273 - protein, 1361 aa, Streptococcus pseudopneumoniae
SNKPYSIGLDIGTNSVGWVIITDDYKVPSKKMKVLGNTDKHFIKKNLIGALLFDEGTTAEDRRLKRTARRRYTRRKNRLRYLQEIFAEEMNKVDSSFFHRLDDSFLVPEDKRGSKYPIFATLAEEKEYHKNFPTIYHLRKQLADSKEKADLRLIYLALAHMIKYRGHFLYEEAFDIKNNDIQKIFNEFINIYDNTFEGSSLSGQNEQVEAIFSDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYQNHQNDLASLKQFIKNNLPEKYDEVFSDQSKDGYAGYVDGKTTQEAFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDSKNEEILENIVHTLTIFEDREMIKQRLAQYDSIFDEKVIKALTRRHYTGWGKLSAKLINGIRDKQTGKTILDYLIDDGYSNRNFMQLINDDGLSFKEIIQKAQVFGKTNDVKQVVQELPGSPAIKKGILQSIKIVEELVKVMGHEPESIVIEMARENQTTTRGKKNSQQRYKRIENSLKILASKILKEHPTDNNQLQNDRLFLYYLQNGKDMYTGEALDINQLSSCDIDHIIPQAFIKDDSLDNRVLTSSKENRGKSDNVPCLEVVDKMKVFWQQLLDFKLISYRKFNNLTKAERGGLDERDKVGFIRRQLVETRQITKHVAQILDSRFNTEVTEKDKKNRNVKIITLKSNLVSNFRKEFGLYKVREINDYHHAHDAYLNAVVAKAILKKYPKLEPEFVYGDYQKYDLSKDPKDIEKATEKYFFYSNLLNFFKEEVHYADGTIVKRENIEYSKDTGEIAWNKEKDFATIKKILSLPQVNIVKKTEEQTGGLFDNNIVSKKKVVDASKLIPIKSGLSPEKYGGYARPTIAYSVLVIADIEKGKTKKLKRIKEMIGITVQDKKIFESNPIAYLEECGYKNINPNLIIKLPKYSLFEFNGGQRRLLASSIELQKGNELILPYHFTALLYHTQRINKISEPIHKQYVEAHQNEFKELLTTIISLSKKYIQKPNVESLLQQAFEQADKDIYQLSESFISLLKLTSFGAPGAFKFLGVEISQSSVRYKPNSQFLDATLIHQSITGLYETRIDLSKLGED

SEQ ID NO: 274 - protein, 1363 aa, Streptococcus pseudopneumoniae
SNKPYSIGLDIGTNSVGWAVITDDYKVPSKKMTVLGNTDKHFIKKNLIGALLFDEGTTAEDRRLKRTARRRYTRRKNRLRYLQEIFSGEMSKVDSSFFHRLDDSFLVPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLTTLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDSKNEAILENIVHTLTIFEDREMIKQRLAQYDSLFDKKVIKALTRRHYTGWGKLSAKLINGICDKQTGNTILDYLIDDGEINRNFMQLINDDGLSFKKIIQKSQVVGETDDVKQVVRELPGSPAIKKGILQSIKIVDELVKVMDHAPESIVIEMARENQTTARGKKNSQQRYKRIEDSLKILASNILKENPTDNNQLQNDRLFLYYLQNGKDMYTGEALDINQLSSYDIDHIIPQAFIKDDSLDNRVLTSSKDNRGKSDNVPSLEVVQKRKAFWQQLLDSKLISERKFNNLTKAERERDGLNELDKVGFIKRQLVETRQITKHVAQILDARFNKEVTEKDKKNRNVKIITLKSNLVSNFRKEFRLYKVREINDYHHAHDAYLNAVVAKAILKKYPKLEPEFVYGDYQKNDLSKDPKDIEKATEKYFFYSNLLNFFKEEVHYADGTIVKRENIEYSKDTGEIAWNKEKDFATIKKVLSYPQVNIVKKTEEQTGGLFDNNIVSKEKVVDASKLIPIKSGLSPEKYGGYARPTIAYSVLVIADIEKGKTKKLKRIKEMVGITIQDKKKFEANPIAYLEECGYKNINPNLIIKLPKYSLFEFNGGQRRLLASSIELQKGNELILPYHFTALLYHAQRINKFSEPIHKQYVEAHQNEFKELLTIIISLSKKYIQKPNVESLLHQAFEQADNDIYQLSESFISLLKLTSFGAPGAFKFLGAEISQSSVRYKPNSQFLDTTLIHQSITGLYETRIDLSKLGED

SEQ ID NO: 275 - protein, 1360 aa, Streptococcus pseudoporcinus
YSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKDDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 276 - protein, 1316 aa, Streptococcus pseudoporcinus
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKDDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 277 - protein, 1359 aa, Streptococcus sanguinis
KKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 278 - protein, 1362 aa, Streptococcus sanguinis
KKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLSKASNTIDKATEKYFFYSNLLNFFKEKVRYADGTIKKRENIEYSNDTGEIAWNKEKDFATIKKVLSLPQVNIVKKTEEQTGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 279 - protein, 1360 aa, Streptococcus sp. F0441
ENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 280 - protein, 1360 aa, Streptococcus sp. FF10
MKKPYSIGLDIGTNSVGWSVVTDDYKVPAKKMKVLGNTDKEYIKKNLIGALLFDSGETAEATRMKRTARRRYTRRRNRILYLQDIFSPELNQVDESFLHRLDDSFLVAEDKRGERHVIFGNIADEVKYHKEFPTIYHLRKHLADSSEKADLRLVYLALAHIIKYRGHFLIDEPIDIRNMNSQNLFKEFLLAFDGIQVDCYLASKHTDISGIITAKISKSRKVEAVLEQFPDQKKNSFFGNMVSLVFGLMPNFKSNFELDEDAKLQFSRDSYDEDLENLLGIIGDEYADVFVAAKKVYDSILLSGILTTNNHSTKAPLSASMIDRYDEHNSDKKLLRDFIRTNIGKEVFKEVFYDTSKNGYAGYIDGKTNQEDFYKYLKNLLQKVDGGDYFIEKIEREDFLRKQRTFDNGSIPHQVHLDEMKAILRRQGEFYPFLKENAEKIQQILTFKIPYYVGPLARGNSRFAWASYNSNEKMTPWNFDNVIDKTSSAQAFIERMTNNDLYLPDQKVLPKHSLLYQKFAVYNELTKIKYVTETGEARLFDVFLKKEIFDGLFKKERKVTKKKILNFLDKNFDEFRITDIQGLDNETGNFNASYGTYHDLLKIIGDKEFMDSSDNVDVLEDIVLSLTLFEDREMIKQRLLKYEDIFSKKVIANLTRRHYTGWGRLSAKLINGIKDKHSRKTILDYLIDDGHSNRNFMQLINDDNLSFKDEIANSQVIGDGDDLHQVVQELAGSPAIKKGILQSLKIVDELVKVMGYNPEQIVVEMARENQTTARGRNNSQQRLGSLTKAIQDFGSDILKRYPVENNQLQNDQLYLYYLQNGKDMYTGDTLDIHNLSQYDIDHIIPQSFIKDNSLDNRVLTNSKSNRGKSDNVPSNEVVKRMKGFWLKQLDAKLISQRKFDNLTKAERGGLSAEDKAGFIKRQLVETRQITKHVARILDERFNRDFDKNDKRIRNVKIVTLKSNLVSNFRKEFGFYKVREINNFHHAHDAYLNAVVAKALLIRYPKLEPEFVYGEYPKYNSYRERKATEKMFFYSNIMNMFKTTIKLADGRVVEKPVIEANEETGEIAWDKTKHFANVKKVLSYPQVSIVKKVEEQTGGFSKESILPKGGSDKLIARKTKNNYLSTQKYGGFDSPTVAYSIMFVADIEKGKSKRLKTVKEMIGITIMERSRFESNSVTFLEEKGYRNIRENTIIKFPKYSLFELENGRRRLLASAIELQKGNEMFLPQQFVNLLYHAQHANKEDSVIYLEKHRHELSELFHHIIGVSEKTILKPKVEMTLNEAFEKHFEFDEVSELAQSFISLLKFTAFGAPGGFKFLDADIKQSNLRYQTVTEVLSSTLIHQSVTGLYETRIDLSKLGGE

SEQ ID NO: 281 - protein, 1364 aa, Streptococcus sp. M334
SNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 282 - protein, 1360 aa, Streptococcus sp. taxon 056
NNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 283 - protein, 1359 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 284 - protein, 1361 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLTLALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 285 - protein, 1361 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 286 - protein, 1359 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFKTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 287 - protein, 1351 aa, Streptococcus suis
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLGKEFDEFRIVDLTGLDKENKVFNSSLGTYHDLRKILDKSFLDNKENEQIIEDIIQTLTLFEDREMIRQRLQKYSDIFTKAQLKKLERCHYTGWGRLSYKLINGIRNKENKKTILDYLIDDGYANRNFMQLINDDALSFKEEIAKAQVIGETDDLNQVVSDIAGSPAIKKGILQSLKIVDELVKVMGYNPANIVIEMARENQTTDKGRRNSQQRLKLLQDSLKPVNIKNVENQQLQNDRLFLYYIQNGKDMYTGETLDINNLSQYDIDHIIPQAFIKDDSFDNRVLTSSSENRGKSDNVPSIEVVRARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVSDKEIGKATAKYFFYSNLMNFFKKEVKFADGTVVERPDIETSEDGEIAWNKQTDFKIVRKVLSYPQVNIVKKTEVQTHGLDRPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASRGEIHKGNELFVPQKFTTLLYHAKRINNPINKDHIEYVKKHRDDFKELLNYVLEFNEKYVGATKNGERLKEAVADFDSKSNEEICTSFLGLFELTSLGSASDFEFLGVKIPRYRDYTPSSLLKDSTLIHQSITGLYETRIDLSKLGED

SEQ ID NO: 288 - protein, 1256 aa, Brochothrix thermosphacta
MWGVSLFEAGKTAAERRGYRSTRRRLNHRKFRLRLLEDMFEKEILSKDPSFFIRLKEAFLSPKDEQKQFLFNDKDYTDADYYEQYKTIYHLRYDLISQHRQFDIREVYLAIHHLIKYRGHFIYEDQTFTTDGNQLQHHIKAIITMINSTLNRIIPETIDINVFEKILLDRMMNRSSKVKFLIELTGKQDKPLLKELFNLIVGLKAKPASIFEQENLATIVETMNMSTEQVQLDLLTLADVLADEEYDLLLTAQKIYSAIILDESMDGYEYFAEAKKESYRKHQEELVLVKKMLKSNAITNDERAKFEYFYTDYIGYEESKSKEERLFKHIELLLAKENVLTTVEHALLEKNITFASLLPLQRSSRNAVIPYQVHEKELVAILENQATYYPFLLEQKDNIHKLLTFRIPYYVGPLADQKDSEFAWMVRKQAGKITPFNFEEMVDIDASSEAFIKRMTNKCTYLIHEDVIPKHSFSYAKFEVLNELNKIRLDGKPIDIPLKKRIFEGLFLEKTKVTQTSLKKWLAEHEHMTVSVVQGTQKETEFATSLQAFHRFVKIFDRETVSNPANEEMFEKIIYWSTVFEDKKIMRRKLSEYPQLTEQQQVQLAQVRFRGWGRLSQRLINRIKTPEDHKLSINEILQTNENFMQIIRNKDYLFKKIIEEQFENETALLNKQRIDELAASPANKKGIWQAIKIVKELEKVLQQPAENIFIEFARSDEESKRSTPRDKFIEKAYAETDTEHLKELKQRSKQLSSQRLFLYFIQNGKCMYSGEHLDIERLDSYEVDHILPQSYIKDNSIENLALVKKVENQRKKDSLLLNSSIINQNYSRWEQLKNAGLIGEKKFRNLTRTKITDRDKEGFIARQLVETRQITKHVTQLLQQEYKDTTKVFAIKATLVSGLRRKFEFIKNRNVNDYHHAQDAFLVAFLGTNITSNYPKIEMEYLFKGYQHYLNEVGKAAKPKFTFIVENLSKQQNSTTGEVKWNPEVDIAKLKRILNFKQCNIVRKVEEQSGALFKETIYPVEESSSKTIPLKKHLDTAIYGGYTAVNYASYALIQFKKGRKLKREIIGIPLAVQTRIDNSETSLQAYIAEQIKSEVEILNGRILKYQLISNNGNRLYIAGSERHNARQLIVSDEAAKVIWLISTKQADEAMFLKYYRLEHLEAVFEELIRKQAADYQIFEKLIKKIEVNFYSCTYNEKVKVIELLKITQANATNGDLKLLKMSNREGRLGSVSVALDFKIINQSVTGLYQSIEDYNN

SEQ ID NO: 289 - protein, 1290 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGDNYNLFIDEDFNDYTYYHKYPTIYHLRKALCESTEKADPRLIYLALHHIVKYRGNFLYEGQKFNMDASNIEDKLSDIFTQFTSFNNIPYEDDKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRKAPVDEFYKYVKKCIEKVDTPEAKQILNDIELENFLLKQNSRTNGSVPYQMQLDEMIKIIDNQAEYYPILKEKREQLLSILTFRIPYYFGPLETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADSVTVLDVLESRLNLMEIINDKDLGYAQMIEEATSCPEDGKFTYEEVERLAGSPALKRGIWQSLQIVEEITKVMKCRPKYIYIEFERSEEKERTESKIKKLENVYKDEQTSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRNKNDQKGFVINSMNYPYEVDGKLIWNPDLINEIKKCFYYKDCYCTTKLDQKSGQLFNTVLSNDAHADKGAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSEYVNARQLVLNEKQCALIADIYNAIYKQDYDNLDDILMIQLYIELTNKMKVLYPAYRGIAEKFESYVVISKEEKANIIQMLIVMHRGPQNGNIVYDDFKISDRIGRLKTKNHNLNIVFISQSPTGIYTKKYKL

SEQ ID NO: 290 - protein, 1359 aa, Artificial Sequence; identical to SEQ ID NO: 108
  Synthetic Polypeptide

SEQ ID NO: 291 - protein, 1317 aa, Clostridiales bacterium S5-A11
MKNYTIGLDIGTNSVGWAVIKDDLTLVRKKIKISGNTDKKEVKKNLWGSFLFEQGDTAQDTRVKRIARRRYERRRFRIRELQKIFDKSMGEVDSNFFHRLDESFLVEEDKEYSKYPIFSNEKEDKNYYDKYPTIYHLRKDLADSNQKADLRLIYLALAHMIKYRGHFLIEGDLKMDGISISESFQEFIDSYNEVCALEDENNDELLTQIENIFKQDISRSKKLDQAIALFQGKRQSLFGIFLTLIVGNKANFQKIFNLEDDIKLDLKEEDYDENLEELLSNIDEGYRDVFLQAKNVYNAIELSKILKTDGKETKAPLSAQMVELYNQHREDLKKYKDYIKAYLPEKYGETFKDATKNGYAGYIDGKTSQEDFYKFVKAQLKGEENGEYFLEAIENENFLRKQRSFYNGVIPYQIHLQELTAVLDQQEKHYSFLKENRDKIISLLTFRIPYYVGPLAKGESRFAWLERSNSEEKIKPWNFDKIVDIDKSAELFIENLTSRDTYLPDEPVLPKRSLIYQKFTIFNELTKISYIDERGILQNFSSREKIAIFNDLFKNKSKVTKNQLVKYIENKEQIIAPEIKGIEDSFNSNYSTYIDLSKIPDMKLLEKDEDEILEEIIKILTIFEDRKMRKRQLMKFKDKLSEKAINQLSKKHYTGWGQLSEKLINGIRDEQSNKTILDYLIDNGCPKNMNRNFMQLINDDTLSFKEKIRKAQDINQVNDIKEIVKDLPGSPAIKKGIYQSIRIVDEIIRKMKDRPKNIVIEMARENQTTQEGKNKSKARLKKIQEGLENLDSHVEKQALDEEMLKSPKYYLYCLQNGKDIYTGKDLDIGQLQTYDIDHIIPRSFITDNSFDNLVLTSSTVNRGKLDNVPSPDIVRQQKGFWKQLLRAGLMSQRKFNNLTKGKLTDRDRQQFINRQLVETRQITKHVANLLSHHLNEKKEVGEINIVLLKSALTSQFRKKFDFYKVREVNDYHHAHDAYLNGVIALKLLELYPYMAKDLIYGKYSYHRKGDKATQAKYKMSNIIERFSQDLLANPDGEIAWEKDKDLNTIRKVLSSKQINIIKKAEEGKGRLFKETINSRPSKKTEKRIPIKNNLDPNIYGGYIEEKMAYYIAINYLENGKTKKAIVGISIKDKKDFEGQTTEYLGKIGFNKASIINSFKNYTLFELENGSRRMIVGKGELQKGNQMYLPQNLLEFVYHLKHYNEDETSHKFIVEHKAYFDELLNYIVEFANKYLELENSIEKIKDLYHGKGPDVEEKELVESFINLLAITKCGPAADITFLGEKISRKRYRSTNCLWGSEVIFQSPTGLYETRLRLE

SEQ ID NO: 292 - protein, 1359 aa, Artificial Sequence; identical to SEQ ID NO: 108
  Synthetic Polypeptide

SEQ ID NO: 293 - protein, 1327 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLED

SEQ ID NO: 294 - protein, 1329 aa, Artificial Sequence
  Synthetic Polypeptide
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 295 - protein, 1280 aa, Artificial Sequence
  Synthetic Polypeptide
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 296 - protein, 1072 aa, Enterococcus durans
MDEEAKIQLSKESYEEELESLLEKSGEEFRDVFLQAKKVYDAILLSDILSTKKQNSKAKLSLGMIERYDSHKKDLEELKQFVKANLPEKTAIFFKDSSKNGYAGYIDGKTTQEDFYKFLKKELNGIAGSERFMEKVDQENFLLKQRTTANGVIPHQVHLTELKAIIERQKPYYPSLEEARDKMIRLLTFRIPYYVGPLAQGEETSSFAWLERKTPEKVTPWNATEVIDYSASAMKFIQRMINYDTYLPTEKVLPKHSILYQKYTIFNELTKVAYKDERGIKHQFSSKEKREIFKELFQKQRKVTVKKLQQFLSANYNIEDAEILGVDKAFNSSYATYHDFLDLAKPNELLEQPEMNAMFEDIVKILTIFEDREMIRTQLKKYQSVLGDGFFKKLVKKHYTGWGRLSERLINGIRDKKTNKTILDYLIDDDFPYNRNRNFMQLINDDSLSFKEELANELALAGNQSLLEVVEALLGSPAIKKGIWQTLKIVEELIEIIGYNPKNIVVEMARENQRTNRSKPRLKALEEALKSFDSPLLKEQPVDNQALQKDRLYLYYLQNGKDMYTGEALDIDRLSEYDIDHIIPRSFIVDNSIDNKVLVSSKENRLKMDDVPDQKVVIRMRRYWEKLLRANLISERKFAYLTKLELTPEDKARFIQRQLVETRQITKHVAAILDQYFNQPEESKNKGIRIITLKSSLVSQFRKTFGINKVREINNHHHAHDAYLNGVVAIALLKKYPKLEPEFVYGNYTKFNLATENKATAKKEFYSNILRFFEKEEYSYDENGEIFWDKARHIPQIKKVISSHQVNIVKKVEVQTGGFYKETVNPKGKPDKLIQRKAGWDVSKYGGFGSPVVAYAVAFIYEKGKARKKAKAIEGITIMKQSLFEQDPIGFLSNKGYSNVTKFIKLSKYTLYELENGRRRMVASKEAQKANSFILPEKLVTLLYHAQHYDEIAHKESFDYVNDHLSEFREILDQVIDFSNRYTIAAKNTEKIAELFEQNQESTVQSLSQSFINLMQLNAMGAPADFKFFDVIIPRKRYPSLTEIWESTIIYQSITGLRETRTRMATLWDGEQ

SEQ ID NO: 297 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 298 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 299 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 300 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 301 - protein, 1331 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKIKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 302 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 303 - protein, 1329 aa, Enterococcus faecalis
MKKDYVIGLDIGSNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQLYNAKSKEKKVQIITLKASLTSQFRSIFGLYKVREVNDYHHGQDAYLNCVVATTLLKVYPNLAPEFVYGEYPKFQTFKENKATAKTIIYTNLMRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 304 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEKFQQFMIIYNQTFVNGEGPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSYAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 305 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKAMAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPERLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 306 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQNEKPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLMRFFTEVEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTKFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFETNQTADVKEIAASFIQLMQFNAMGAPSTFKFFQKDIERARYTSIKEIFDATIIYQSTTGLYETRRKVVD

SEQ ID NO: 307 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 308 - protein, 1328 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 309 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 310 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 311 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 312 - protein, 1328 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 313 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 314 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

(The sequence listing continues in the following parts.)

What is claimed is:

1. An adenosine deaminase comprising an amino acid sequence that is at least 85% identical to the amino acid sequence of SEQ ID NOs: 1, 8, 9, 371, 372, 373, 374, or 375, with the exception of one or more substitutions at positions selected from the group consisting of amino acid residues corresponding to positions 8, 17, 18, 23, 34, 36, 45, 48, 51, 56, 59, 84, 85, 94, 95, 102, 104, 106, 107, 108, 110, 118, 123, 127, 138, 142, 146, 147, 149, 151, 152, 153, 154, 155, 156, and 157 of the amino acid sequence of SEQ ID NO: 1, wherein the adenosine deaminase deaminates adenine in deoxyribonucleic acid (DNA).

2. The adenosine deaminase of claim 1, wherein said adenosine deaminase is a TadA deaminase.

3. A base editor for modifying a base within a nucleic acid sequence, wherein the base editor comprises:

a) a nucleic acid programmable DNA binding protein (napDNAbp) domain, wherein said napDNAbp domain site specifically binds said nucleic acid sequence when associated with a bound nucleic acid; and
b) an adenosine deaminase domain comprising said adenosine deaminase of claim 1.

4. The base editor of claim 3, wherein said napDNAbp domain comprises a Cas9 domain, a Cpf1 domain, a CasX domain, a CasY domain, a C2c1 domain, a C2c2 domain, or a C2c3 domain.

5. The base editor of claim 3, wherein said napDNAbp domain comprises a Cas9 domain.

6. The base editor of claim 5, wherein said Cas9 domain comprises a nuclease dead Cas9 (dCas9), a Cas9 nickase (nCas9), or a nuclease active Cas9.

7. The base editor of claim 5, wherein said Cas9 domain comprises a Cas9 nickase (nCas9).

8. The base editor of claim 3, wherein said adenosine deaminase is a TadA deaminase.

9. The base editor of claim 3, wherein said adenosine deaminase domain is fused to the N-terminus of said napDNAbp domain.

10. The base editor of claim 9, wherein said adenosine deaminase domain is fused via a linker.

11. The base editor of claim 3, wherein said base editor further comprises a second adenosine deaminase domain.

12. The base editor of claim 11, wherein said second adenosine deaminase domain is fused to the N-terminus of said adenosine deaminase.

13. The base editor of claim 11, wherein said second adenosine deaminase domain does not deaminate adenosine in DNA.

14. The base editor of claim 11, wherein said second adenosine deaminase domain is capable of deaminating adenosine in DNA.

15. A method for editing a nucleobase of a DNA sequence, the method comprising contacting said DNA sequence with said adenosine deaminase of claim 1.

16. The method of claim 15, wherein said adenosine deaminase is a TadA deaminase.

17. A method comprising introducing said adenosine deaminase of claim 1, or a nucleic acid encoding said adenosine deaminase, to a cell.

18. A method comprising introducing said base editor of claim 3, or a nucleic acid encoding said base editor, to a cell.

19. The adenosine deaminase of claim 1, wherein the adenosine deaminase comprises an amino acid sequence that is at least 85% identical to the amino acid sequence of SEQ ID NO: 1.

20. The adenosine deaminase of claim 1, wherein the adenosine deaminase comprises an amino acid sequence that is at least 85% identical to the amino acid sequence of SEQ ID NO: 8.

21. The base editor of claim 3 further comprising an inhibitor of base excision repair.

22. The base editor of claim 21, wherein the inhibitor of base excision repair is a catalytically inactive inosine-specific nuclease (dISN).

23. The base editor of claim 11, wherein said second adenosine deaminase domain is fused to the C-terminus of said adenosine deaminase.

\* \* \* \* \*